US007226785B2

(12) United States Patent
Kmiec et al.

(10) Patent No.: US 7,226,785 B2
(45) Date of Patent: Jun. 5, 2007

(54) TARGETED CHROMOSOMAL GENOMIC ALTERATIONS WITH MODIFIED SINGLE STRANDED OLIGONUCLEOTIDES

(75) Inventors: Eric B Kmiec, Landenberg, PA (US); Howard B Gamper, Philadelphia, PA (US); Michael C Rice, Newtown, PA (US)

(73) Assignee: University of Delaware, Newark, DE (US)

( * ) Notice: Subject to any disclaimer, the term of this patent is extended or adjusted under 35 U.S.C. 154(b) by 468 days.

(21) Appl. No.: 10/261,185

(22) Filed: Sep. 27, 2002

(65) Prior Publication Data

US 2004/0014057 A1 Jan. 22, 2004

Related U.S. Application Data

(63) Continuation of application No. PCT/US01/09761, filed on Mar. 27, 2001.

(60) Provisional application No. 60/244,989, filed on Oct. 30, 2000, provisional application No. 60/208,538, filed on Jun. 1, 2000, provisional application No. 60/192,179, filed on Mar. 27, 2000, provisional application No. 60/192,176, filed on Mar. 27, 2000.

(51) Int. Cl.
*C12N 15/00* (2006.01)
(52) U.S. Cl. .................. 435/440; 435/455; 435/463; 435/471
(58) Field of Classification Search ................ 435/455, 435/440, 463, 471; 536/24.1
See application file for complete search history.

(56) References Cited

U.S. PATENT DOCUMENTS

| 5,565,350 | A | 10/1996 | Kmiec | 435/172.3 |
|---|---|---|---|---|
| 5,731,181 | A | 3/1998 | Kmiec | 435/172.3 |
| 5,801,154 | A | 9/1998 | Baracchini | 514/44 |
| 5,912,340 | A | 6/1999 | Kutyavin | 536/24.5 |
| 5,955,363 | A | 9/1999 | Lewis | 435/440 |
| 6,004,804 | A | 12/1999 | Kumar | 435/320.1 |
| 6,136,601 | A | 10/2000 | Meyer | 435/375 |
| 6,271,360 | B1 | 8/2001 | Metz | 536/23.1 |
| 2002/0119570 | A1 | 8/2002 | Yoon | 435/455 |

FOREIGN PATENT DOCUMENTS

| WO | WO 99/14226 | 3/1999 |
|---|---|---|
| WO | WO 99/58702 | 11/1999 |
| WO | WO 00/56748 | 9/2000 |
| WO | WO 00/66604 | 11/2000 |
| WO | WO 01/15740 | 3/2001 |
| WO | WO 01/92512 | 12/2001 |
| WO | WO 02/26967 | 4/2002 |

OTHER PUBLICATIONS

Verfaillie et al. (Hematology, 2002; pp. 369-391).*
Sylvester et al. (Arch Surg., 2004; vol. 139, pp. 93-99).*
Stojkovic et al. (Reproduction, 2004; vol. 128, pp. 259-267).*
Wobus et al. (Physiol. Rev., 2005; vol. 85, pp. 635-678).*
Alexeev et al., "Stable and inheritable changes in genotype and phenotype of albino melanocytes induced by an RNA-DNA oligonucleotide," *Nature Biotech.* 16:1343-1346 (1998).
Campbell et al., "Homologous recombination involving small single-stranded oligonucleotides in human cells," *New Biologist* 1:223-227 (1989).
Chan et al., "Targeted correction of an episomal gene in mammalian cells by a short DNA fragment tethered to a triplex-forming oligonucleotide," *J. Biol. Chem.* 274:11541-11548 (1999).
Chan et al., "Triplex DNA: fundamentals, advances, and potential applications for gene therapy," *J. Mol. Med.* 75:267-282 (1997).
Cole-Strauss et al., "Correction of the mutation responsible for sickle cell anemia by an RNA-DNA oligonucleotide," *Science* 273:1386-1389 (1996).
Crystal, Ronald G., "Transfer of Genes to Humans: Early Lessons and Obstacles to Success," *Science* 270: 404-410 (1995).
Culver et al., "Correction of chromosomal point mutations in human cells with bifunctional oligonucleotides," *Nat. Biotechnol.* 17:989-993 (1999).
Gamper et al., "A plausible mechanism for gene correction by chimeric oligonucleotides," *Biochemistry* 39(19): 5808-16 (2000).
Gamper et al., "The DNA strand of chimeric RNA/DNA oligonucleotides can direct gene repair/conversion activity in mammalian and plant cell-free extracts," *Nucleic Acids Res.* 28:4332-4339 (2000).
Igoucheva et al., "Targeted gene correction by small single-stranded oligonucleotides in mammalian cells," *Gene Therapy* 8:391-399 (2001).
Kaji et al., "Gene and Stem Cell Therapies," *JAMA* 285(5): 545-550 (2001).
Kmiec et al., "Targeted gene repair in mammalian cells using chimeric RNA/DNA oligonucleotides," *Cold Spring Harbor Monograph Series* 36:643-670 (1999).
Kren et al., "Correction of the UDP-glucuronosyltransferase gene defect in the Gunn rat model of Crigler-Najjar syndrome type I with a chimeric oligonucleotide," *Proc. Natl. Acad. Sci. USA* 96:10349-10354 (1999).
Kunzelmann et al., "Gene targeting of CFTR DNA in CF epithelial cells," *Gene Ther.* 3:859-867 (1996).
Liu et al., "In vivo gene repair of point and frameshift mutations directed by chimeric RNA/DNA oligonucleotides and modified single-stranded oligonucleotides," *Nucl. Acids Res.* 29(20): 4238-50 (2001).

(Continued)

*Primary Examiner*—Jon E. Angell
(74) *Attorney, Agent, or Firm*—McCarter & English

(57) ABSTRACT

Presented are methods and compositions for targeted chromosomal genomic alterations using modified single-stranded oligonucleotides of the invention have at least one modified nuclease-resistant terminal region comprising phosphorothioate linkages, LNA analogs or 2'-O-Me base analogs.

45 Claims, 12 Drawing Sheets

OTHER PUBLICATIONS

Moerschell et al., "Transformation of yeast with synthetic oligonucleotides," *Proc. Natl. Acad. Sci. USA* 85:524-528 (1988).

Ørum et al., "Detection of the factor V Leiden mutation by direct allele-specific hybridization of PCR amplicons to photoimmobilized locked nucleic acids," *Clinical Chemistry* 45(11): 1898-1905 (1999).

Rando et al., "Rescue of dystrophin expression in *mdx* mouse muscle by RNA/DNA oligonucleotides," *Proc. Natl. Acad. Sci. USA* 97:5363-5368 (2000).

Rice et al., "The potential of nucleic acid repair in functional genomics," *Nature Biotech.* 19(4): 321-26 (2001).

Santisteban et al., "Three new adenosine deaminase mutations that define a splicing enhancer and cause severe and partial phenotypes: Implications for evolution of a CpG hotspot and expression of a transduced ADA cDNA," *Human Molec. Genetics* 4(11): 2081-87 (1995).

Sayers et al., "5'-3' Exonucleases in Phosphorothioate-based Oligonucleotide-directed Mutagenesis," *Nucleic Acids Research* 16(3): 791-801 (1988).

Vasquez et al., "Chromosomal mutations induced by triplex-forming oligonucleotides in mammalian cells," *Nucl. Acids Res.* 27:1176-1181 (1999).

Vasquez et al., "Specific mutations induced by triplex-forming oligonucleotides in mice," *Science* 290:530-532 (2000).

Verma et al., "Gene Therapy—Promises, Problems, and Prospects," *Nature* 389: 239-242 (1997).

Woolf et al., "Toward the therapeutic editing of mutated RNA sequences," *Proc. Natl. Acad. Sci. USA* 92: 8298-8302 (1995).

Xu et al., "Activation of human γ-globin gene expression via triplex-forming oligonucleotide (TFO)-directed mutations in the γ-globin gene 5' flanking region," *Gene* 242:219-228 (2000).

Yamamoto et al., "Strand-specificity in the transformation of yeast with synthetic oligonucleotides," *Genetics* 131:811-819 (1992).

Yanez et al., "Therapeutic gene targeting," *Gene Therapy* 5:149-159 (1998).

* cited by examiner

DNA SEQUENCE ANALYSIS OF Kan[r] PLASMIDS

| TARGET CODON DISTRIBUTION | | | | | |
|---|---|---|---|---|---|
| OLIGOMER | TAG | TAC | TAC/TAG | TGG | TCG |
| 1) 3S/25G (20) | --- | + | --- | --- | --- |
| 2) 6S/25G (20) | --- | + | --- | --- | --- |
| 3) 8S/25G (20) | --- | + | --- | --- | --- |
| 4) 10S/25G (18) | --- | + | --- | +(2) | +(2) |
| 5) 25S/25G (4) | --- | --- | +(2) | +(2) | --- |

3S/25G

6S/25G

8S/25G

10S/25G

25S/25G

25S/25G

SEQUENCE OF NORMAL ALLELE: GTGGATATGTCCT
TARGET/EXISTING MUTANT: GTGGATAATGTCCT
DESIRED ALTERATION: GTGGATACGTCCT

SEQUENCE OF NORMAL ALLELE: GTGGATATGTCCT
TARGET/EXISTING MUTANT: GTGGATAGGTCCT
DESIRED ALTERATION: GTGGATACGTCCT

HygE3T/25: 5'-AGG GCG TGG ATA CGT CCT GCG GGT A-3'

HygE3T/74: 5'-CTC GTG CTT TCA GCT TCG ATG TAG GAG GGC
GTG GAT ACG TCC TGC GGG TAA ATA GCT GCG
CCG ATG GTT TCT AC-3'

HygE3T/74α: 5'-GTA GAA ACC ATC GGC GCA GCT ATT TAC CCG
CAG GAC GTA TCC ACG CCC TCC TAC ATC GAA
GCT GAA AGC ACG AG-3'

HygGG/Rev:

Kan70T: 5'-CAT CAG AGC AGC CAA TTG TCT GTT GTG CCC AGT
CGT AGC CGA ATA GCC TCT CCA CCC AAG CGG CCG GAG
A-3'

US 7,226,785 B2

TARGETED CHROMOSOMAL GENOMIC ALTERATIONS WITH MODIFIED SINGLE STRANDED OLIGONUCLEOTIDES

CROSS REFERENCE TO RELATED APPLICATIONS

This application is a continuation of International Patent Application No. PCT/US01/09761, filed Mar. 27, 2001, which designated the United States and which claims the benefit under 35 U.S.C. 119(e) of U.S. Provisional Application Nos. 60/244,989, filed Oct. 30, 2000; 60/208,538, filed Jun. 1, 2000; 60/192,176, filed Mar. 27, 2000; and 60/192,179, filed Mar. 27, 2000.

STATEMENT REGARDING FEDERALLY FUNDED RESEARCH

This invention was made in the course of research under N.I.H. grants R01 HL58563-05 and R01 DK56134-03. The government has certain rights in this invention.

INCORPORATION BY REFERENCE OF MATERIALS FILED ON COMPACT DISC

The present application includes a Sequence Listing filed on a single compact disc (CD-R), filed in duplicate. The Sequence Listing is presented in a single file on each CD-R and is named SequenceListingNapro4. The Sequence Listing was last modified Apr. 18, 2003 at 10:24:54 AM and comprises 930,640 bytes.

FIELD OF THE INVENTION

The technical field of the invention is oligonucleotide-directed repair or alteration of genetic information using novel chemically modified oligonucleotides. Such genetic information is preferably from a eukaryotic organism, i.e. a plant, animal or fungus.

BACKGROUND OF THE INVENTION

A number of methods have been developed specifically to alter the sequence of an isolated DNA in addition to methods to alter directly the genomic information of various plants, fungi and animals, including humans ("gene therapy"). The latter methods generally include the use of viral or plasmid vectors carrying nucleic acid sequences encoding partial or complete portions of a particular protein which is expressed in a cell or tissue to effect the alteration. The expression of the particular protein then results in the desired phenotype. For example, retroviral vectors containing a transgenic DNA sequence allowing for the production of a normal CFTR protein when administered to defective cells are described in U.S. Pat. No. 5,240,846. Others have developed different "gene therapy vectors" which include, for example, portions of adenovirus (Ad) or adeno-associated virus (AAV), or other viruses. The virus portions used are often long terminal repeat sequences which are added to the ends of a transgene of choice along with other necessary control sequences which allow expression of the transgene. See U.S. Pat. Nos. 5,700,470 and 5,139,941. Similar methods have been developed for use in plants. See, for example, U.S. Pat. No. 4,459,355 which describes a method for transforming plants with a DNA vector and U.S. Pat. No. 5,188,642 which describes cloning or expression vectors containing a transgenic DNA sequence which when expressed in plants confers resistance to the herbicide glyphosate. The use of such transgene vectors in any eukaryotic organism adds one or more exogenous copies of a gene, which gene may be foreign to the host, in a usually random fashion at one or more integration sites of the organism's genome at some frequency. The gene which was originally present in the genome, which may be a normal allelic variant, mutated, defective, and/or functional, is retained in the genome of the host.

These methods of gene correction are problematic in that complications which can compromise the health of the recipient, or even lead to death, may result. One such problem is that insertion of exogenous nucleic acid at random location(s) in the genome can have deleterious effects. Another problem with such systems includes the addition of unnecessary and unwanted genetic material to the genome of the recipient, including, for example, viral or other vector remnants, control sequences required to allow production of the transgene protein, and reporter genes or resistance markers. Such remnants and added sequences may have presently unrecognized consequences, for example, involving genetic rearrangements of the recipient genomes. Other problems associated with these types of traditional gene therapy methods include autoimmune suppression of cells expressing an inserted gene due to the presence of foreign antigens. Concerns have also been raised with consumption, especially by humans, of plants containing exogenous genetic material.

More recently, simpler systems involving poly- or oligo-nucleotides have been described for use in the alteration of genomic DNA. These chimeric RNA-DNA oligonucleotides, requiring contiguous RNA and DNA bases in a double-stranded molecule folded by complementarity into a double hairpin conformation, have been shown to effect single basepair or frameshift alterations, for example, for mutation or repair of plant or animal genomes. See, for example, WO 99/07865 and U.S. Pat. No. 5,565,350. In the chimeric RNA-DNA oligonucleotide, an uninterrupted stretch of DNA bases within the molecule is required for sequence alteration of the targeted genome while the obligate RNA residues are involved in complex stability. Due to the length, backbone composition, and structural configuration of these chimeric RNA-DNA molecules, they are expensive to synthesize and difficult to purify. Moreover, if the RNA-containing strand of the chimeric RNA-DNA oligonucleotide is designed so as to direct gene conversion, a series of mutagenic reactions resulting in nonspecific base alteration can result. Such a result compromises the utility of such a molecule in methods designed to alter the genomes of plants and animals, including in human gene therapy applications.

Alternatively, other oligo- or poly-nucleotides have been used which require a triplex forming, usually polypurine or polypyrimidine, structural domain which binds to a DNA helical duplex through Hoogsteen interactions between the major groove of the DNA duplex and the oligonucleotide. Such oligonucleotides may have an additional DNA reactive moiety, such as psoralen, covalently linked to the oligonucleotide. These reactive moieties function as effective intercalation agents, stabilize the formation of a triplex and can be mutagenic. Such agents may be required in order to stabilize the triplex forming domain of the oligonucleotide with the DNA double helix if the Hoogsteen interactions from the oligonucleotide/target base composition are insufficient. See, e.g., U.S. Pat. No. 5,422,251. The utility of these oligonucleotides for directing gene conversion is compromised by a high frequency of nonspecific base changes.

In more recent work, the domain for altering a genome is linked or tethered to the triplex forming domain of the bi-functional oligonucleotide, adding an additional linking or tethering functional domain to the oligonucleotide. See, e.g., Culver et al., *Nature Biotechnology* 17: 989-93 (1999). Such chimeric or triplex forming molecules have distinct structural requirements for each of the different domains of the complete poly- or oligo-nucleotide in order to effect the desired genomic alteration in either episomal or chromosomal targets.

Other genes, e.g. CFTR, have been targeted by homologous recombination using duplex fragments having several hundred basepairs. See, e.g., Kunzelmann et al., *Gene Ther*. 3:859-867 (1996). Early experiments to mutagenize an antibiotic resistance indicator gene by homologous recombination used an unmodified DNA oligonucleotide with no functional domains other than a region of complementary sequence to the target See Campbell et al., *New Biologist* 1: 223-227 (1989). These experiments required large concentrations of the oligonucleotide, exhibited a very low frequency of episomal modification of a targeted exogenous plasmid gene not normally found in the cell and have not been reproduced. However, as shown in the examples herein, we have observed that an unmodified DNA oligonucleotide can convert a base at low frequency which is detectable using the assay systems described herein.

Artificial chromosomes can be useful for the screening purposed identified herein. These molecules are man-made linear or circular DNA molecules constructed from essential cis-acting DNA sequence elements that are responsible for the proper replication and partitioning of natural chromosomes (Murray et al., 1983). The essential elements are: (1) Autonomous Replication Sequences (ARS), (2) Centromeres, and (3) Telomeres.

Yeast artificial chromosomes (YACs) allow large genomic DNA to be modified and used for generating transgenic animals [Burke et al., Science 236:806; Peterson et al., Trends Genet. 13:61 (1997); Choi, et al., Nat. Genet, 4:117-223 (1993), Davies, et al., Biotechnology 11:911-914 (1993), Matsuura, et al., Hum. Mol. Genet., 5:451-459 (1996), Peterson et al., Proc. Natl. Acad. Sci., 93:6605-6609 (1996); and Schedl, et al., Cell, 86:71-82 (1996)]. Other vectors also have been developed for the cloning of large segments of mammalian DNA, including cosmids, and bacteriophage P1 [Sternberg et al., Proc. Natl. Acad. Sci. U.S.A., 87:103-107 (1990)]. YACs have certain advantages over these alternative large capacity cloning vectors [Burke et al., Science, 236:806-812 (1987)]. The maximum insert size is 35-30 kb for cosmids, and 100 kb for bacteriophage P1, both of which are much smaller than the maximal insert for a YAC.

An alternative to YACs are *E. coli* based cloning systems based on the *E. coli* fertility factor that have been developed to construct large genomic DNA insert libraries. They are bacterial artificial chromosomes (BACs) and P-1 derived artificial chromosomes (PACs) [Mejia et al., Genome Res. 7:179-186 (1997); Shizuya et al., Proc. Natl. Acad. Sci. 89:8794-8797 (1992); Ioannou et al., Nat. Genet., 6:84-89 (1994); Hosoda et al., Nucleic Acids Res. 18:3863 (1990)]. BACs are based on the *E. coli* fertility plasmid (F factor); and PACs are based on the bacteriophage P1. These vectors propagate at a very low copy number (1-2 per cell) enabling genomic inserts up to 300 kb in size to be stably maintained in recombination deficient hosts. Furthermore, the PACs and BACs are circular DNA molecules that are readily isolated from the host genomic background by classical alkaline lysis [Birnboim et al., Nucleic Acids Res. 7:1513-1523 (1979].

Oligonucleotides designed for use in the alteration of genetic information are significantly different from oligonucleotides designed for antisense approaches. For example, antisense oligonucleotides are perfectly complementary to and bind an mRNA strand in order to modify expression of a targeted mRNA and are used at high concentration. As a consequence, they are unable to produce a gene conversion event by either mutagenesis or repair of a defect in the chromosomal DNA of a host genome. Furthermore, the backbone chemical composition used in most oligonucleotides designed for use in antisense approaches renders them inactive as substrates for homologous pairing or mismatch repair enzymes and the high concentrations of oligonucleotide required for antisense applications can be toxic with some types of nucleotide modifications. In addition, antisense oligonucleotides must be complementary to the mRNA and therefore, may not be complementary to the other DNA strand or to genomic sequences that span the junction between intron sequence and exon sequence.

A need exists for simple, inexpensive oligonucleotides capable of producing targeted alteration of genetic material such as those described herein as well as methods to identify optimal oligonucleotides that accurately and efficiently alter target DNA.

SUMMARY OF THE INVENTION

Novel, modified single-stranded nucleic acid molecules that direct gene alteration in plants, fungi and animals are identified and the efficiency of alteration is analyzed both in vitro using a cell-free extract assay and in vivo using a yeast cell system. The alteration in an oligonucleotide of the invention may comprise an insertion, deletion, substitution, as well as any combination of these. Site specific alteration of DNA is not only useful for studying function of proteins in vivo, but it is also useful for creating animal models for human disease, and in gene therapy. As described herein, oligonucleotides of the invention target directed specific gene alterations in genomic double-stranded DNA cells. The target DNA can be normal, cellular chromosomal DNA, extrachromosomal DNA present in cells in different forms including, e.g., mammalian artificial chromosomes (MACs), PACs from P-1 vectors, yeast artificial chromosomes (YACs), bacterial artificial chromosomes (BACs), plant artificial chromosomes (PLACs), as well as episomal DNA, including episomal DNA from an exogenous source such as a plasmid or recombinant vector. Many of these artificial chromosome constructs containing human DNA can be obtained from a variety of sources, including, e.g., the Whitehead Institute, and are described, e.g., in Cohen et al., Nature 336:698-701 (1993) and Chumakov, et al., Nature 377:174-297 (1995). The target DNA may be transitionally silent or active. In a preferred embodiment, the target DNA to be altered is the non-transcribed strand of a genomic DNA duplex.

The low efficiency of gene alteration obtained using unmodified DNA oligonucleotides is believed to be largely the result of degradation by nucleases present in the reaction mixture or the target cell. Although different modifications are known to have different effects on the nuclease resistance of oligonucleotides or stability of duplexes formed by such oligonucleotides (see, e.g., Koshkin et al., *J. Am. Chem. Soc.*, 120:13252-3), we have found that it is not possible to predict which of any particular known modification would be most useful for any given alteration event, including for the construction of gene conversion oligonucleotides, because of the interaction of different as yet unidentified proteins during the gene alteration event. Herein, a variety of nucleic acid analogs have been developed that increase the nuclease resistance of oligonucleotides that contain them, including, e.g., nucleotides containing phosphorothioate linkages or 2'-O-methyl analogs. We recently discovered that single-stranded DNA oligonucleotides modified to contain 2'-O-methyl RNA nucleotides or phosphorothioate linkages can enable specific alteration of genetic information at a higher level than either unmodified single-stranded DNA or a chimeric RNA/DNA molecule. See priority applications incorporated herein in their entirety; see also Gamper et al., *Nucleic Acids Research* 28: 4332-4339 (2000). We also found that additional nucleic acid analogs which increase the nuclease resistance of oligonucleotides that contain them, including, e.g., "locked nucleic acids" or "LNAs", xylo-LNAs and L-ribo-LNAs; see, for example, Wengel & Nielsen, WO 99/14226; Wengel, WO 00/56748 and Wengel, WO 00/66604; also allow specific targeted alteration of genetic information.

The assay allows for determining the optimum length of the oligonucleotide, optimum sequence of the oligonucleotide, optimum position of the mismatched base or bases, optimum chemical modification or modifications, optimum strand targeted for identifying and selecting the most efficient oligonucleotide for a particular gene alteration event by comparing to a control oligonucleotide. Control oligonucleotides may include a chimeric RNA-DNA double hairpin oligonucleotide directing the same gene alteration event, an oligonucleotide that matches its target completely, an oligonucleotide in which all linkages are phosphorothiolated, an oligonucleotide fully substituted with 2'-O-methyl analogs or an RNA oligonucleotide. Such control oligonucleotides either fail to direct a targeted alteration or do so at a lower efficiency as compared to the oligonucleotides of the invention. The assay further allows for determining the optimum position of a gene alteration event within an oligonucleotide, optimum concentration of the selected oligonucleotide for maximum alteration efficiency by systematically testing a range of concentrations, as well as optimization of either the source of cell extract by testing different organisms or strains, or testing cells derived from different organisms or strains, or cell lines. Using a series of single-stranded oligonucleotides, comprising all RNA or DNA residues and various mixtures of the two, several new structures are identified as viable molecules in nucleotide conversion to direct or repair a genomic mutagenic event. When extracts from mammalian, plant and fungal cells are used and are analyzed using a genetic readout assay in bacteria, single-stranded oligonucleotides having one of several modifications are found to be more active than a control RNA-DNA double hairpin chimera structure when evaluated using an in vitro gene repair assay. Similar results are also observed in vivo using yeast, mammalian, rodent, monkey, human and embryonic cells, including stem cells. Molecules containing various lengths of modified bases were found to possess greater activity than unmodified single-stranded DNA molecules.

DETAILED DESCRIPTION OF THE INVENTION

The present invention provides oligonucleotides having chemically modified, nuclease resistant residues, preferably at or near the termini of the oligonucleotides, and methods for their identificaton and use in targeted alteration of genetic material, including gene mutation, targeted gene repair and gene knockout. The oligonucleotides are preferably used for mismatch repair or alteration by changing at least one nucleic acid base, or for frameshift repair or alteration by addition or deletion of at least one nucleic acid base. The oligonucleotides of the invention direct any such alteration, including gene correction, gene repair or gene mutation and can be used, for example, to introduce a polymorphism or haplotype or to eliminate ("knockout") a particular protein activity.

The oligonucleotides of the invention are designed as substrates for homologous pairing and repair enzymes and as such have a unique backbone composition that differs from chimeric RNA-DNA double hairpin oligonucleotides, antsense oligonucleotides, and/or other poly- or oligo-nucleotides used for altering genomic DNA, such as triplex forming oligonucleotides. The single-stranded oligonucleotides described herein are inexpensive to synthesize and easy to purify. In side-by-side comparisons, an optimized single-stranded oligonucleotide comprising modified residues as described herein is significantly more efficient than a chimeric RNA-DNA double hairpin oligonucleotide in directing a base substitution or frameshift mutation in a cell-free extract assay.

We have discovered that single-stranded oligonucleotides having a DNA domain surrounding the targeted base, with the domain preferably central to the poly- or oligo-nucleotide, and having at least one modified end, preferably at the 3' terminal region are able to alter a target genetic sequence and with an efficiency that is higher than chimeric RNA-DNA double hairpin oligonucleotides disclosed in U.S. Pat. No. 5,565,350. Oligonucleotides of the invention can efficiently be used to introduce targeted alterations in a genetic sequence of DNA in the presence of human, animal, plant, fungal (including yeast) proteins and in cultured cells of human liver, lung, colon, cervix, kidney, epethelium and cancer cells and in monkey, hamster, rat and mouse cells of different types, as well as embryonic stem cells. Cells for use in the invention include, e.g., fungi including *S. cerevisiae, Ustillago maydis* and *Candida albicans*, mammalian, mouse, hamster, rat, monkey, human and embryonic cells including stem cells. The DNA domain is preferably fully complementary to one strand of the gene target, except for the mismatch base or bases responsible for the gene alteration or conversion events. On either side of the preferably central DNA domain, the contiguous bases may be either RNA bases or, preferably, are primarily DNA bases. The central DNA domain is generally at least 8 nucleotides in length. The base(s) targeted for alteration in the most preferred embodiments are at least about 8, 9 or 10 bases from one end of the oligonucleotide.

According to certain embodiments, the termini of the oligonucleotides of the present invention comprise phosphorothioate modifications, LNA backbone modifications, or 2'-O-methyl base analogs, or any combination of these modifications. Oligonucleotides comprising 2'-O-methyl or LNA analogs are a mixed DNA/RNA polymer. These oligonucleotides are, however, single-stranded and are not designed to form a stable internal duplex structure within the oligonucleotide. The efficiency of gene alteration is surprisingly increased with oligonucleotides having internal complementary sequence comprising phosphorothioate modified bases as compared to 2'-O-methyl modifications. This result indicates that specific chemical interactions are involved between the converting oligonucleotide and the proteins involved in the conversion. The effect of other such chemical interactions to produce nuclease resistant termini using modifications other than LNA, phosphorothioate linkages, or 2'-O-methyl analog incorporation into an oligonucleotide can not yet be predicted because the proteins involved in the alteration process and their particular chemical interaction with the oligonucleotide substituents are not yet known and cannot be predicted.

In the examples, correcting oligonucleotides of defined sequence are provided for correction of genes mutated in human diseases. In the tables of these examples, the oligonucleotides of the invention are not limited to the particular sequences disclosed. The oligonucleotides of the invention include extensions of the appropriate sequence of the longer 120 base oligonucleotides which can be added base by base to the smallest disclosed oligonucleotides of 17 bases. Thus the oligonucleotides of the invention include for each correcting change, oligonucleotides of length 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, or 120 with further single-nucleotide additions up to the longest sequence disclosed. Moreover, the oligonucleotides of the invention do not require a symmetrical extension on either side of the central DNA domain. Similarly, the oligonucleotides of the invention as disclosed in the various tables for correction of human diseases contain phosphorothioate linkages, 2'-O-methyl analogs or LNAs or any combination of these modifications just as the assay oligonucleotides do.

The present invention, however, is not limited to oligonucleotides that contain any particular nuclease resistant modification. Oligonucleotides of the invention may be altered with any combination of additional LNAs, phosphorothioate linkages or 2'-O-methyl analogs to maximize conversion efficiency. For oligonucleotides of the invention that are longer than about 17 to about 25 bases in length, internal as well as terminal region segments of the backbone may be altered. Alternatively, simple fold-back structures at each end of a oligonucleotide or appended end groups may be used in addition to a modified backbone for conferring additional nuclease resistance.

The different oligonucleotides of the present invention preferably contain more than one of the aforementioned backbone modifications at each end. In some embodiments, the backbone modifications are adjacent to one another. However, the optimal number and placement of backbone modifications for any individual oligonucleotide will vary with the length of the oligonucleotide and the particular type of backbone modification(s) that are used. If constructs of identical sequence having phosphorothioate linkages are compared, 2, 3, 4, 5, or 6 phosphorothioate linkages at each end are preferred. If constructs of identical sequence having 2'-O-methyl base analogs are compared, 1, 2, 3 or 4 analogs are preferred. The optimal number and type of backbone modifications for any particular oligonucleotide useful for altering target DNA may be determined empirically by comparing the alteration efficiency of the oligonucleotide comprising any combination of the modifications to a control molecule of comparable sequence using any of the assays described herein. The optimal positon(s) for oligonucleotide modifications for a maximally efficient altering oligonucleotide can be determined by testing the various modifications as compared to control molecule of comparable sequence in one of the assays disclosed herein. In such assays, a control molecule includes, e.g., a completely 2'-O-methyl substituted molecule, a completely complementary oligonucleotide, or a chimeric RNA-DNA double hairpin.

Increasing the number of phosphorothioate linkages, LNAs or 2'-O-methyl bases beyond the preferred number generally decreases the gene repair activity of a 25 nucleotide long oligonucleotide. Based on analysis of the concentration of oligonucleotide present in the extract after different time periods of incubation, it is believed that the terminal modifications impart nuclease resistance to the oligonucleotide thereby allowing it to survive within the cellular environment. However, this may not be the only possible mechanism by which such modifications confer greater efficiency of conversion. For example, as disclosed herein, certain modifications to oligonucleotides confer a greater improvement to the efficiency of conversion than other modifications.

Efficiency of conversion is defined herein as the percentage of recovered substate molecules that have undergone a conversion event. Depending on the nature of the target genetic material, e.g. the genome of a cell, efficiency could be represented as the proportion of cells or clones containing an extrachromosomal element that exhibit a particular phenotype. Alternatively, representative samples of the target genetic material can be sequenced to determine the percentage that have acquired the desire change. The oligonucleotides of the invention in different embodiments can alter DNA one, two, three, four, five, six, seven, eight, nine, ten, twelve, fifteen, twenty, thirty, and fifty or more fold more than control oligonucleotides. Such control oligonucleotides are oligonucleotides with fully phosphorothiolated linkages, oligonucleotides that are fully substituted with 2'-O-methyl analogs, a perfectly matched oligonucleotide that is fully complementary to a target sequence or a chimeric DNA-RNA double hairpin oligonucleotide such as disclosed in U.S. Pat. No. 5,565,350.

In addition, for a given oligonucleotide length, additional modifications interfere with the ability of the oligonucleotide to act in concert with the cellular recombination or repair enzyme machinery which is necessary and required to mediate a targeted substitution, addition or deletion event in DNA. For example, fully phosphorothiolated or fully 2-O-methylated molecules are inefficient in targeted gene alteration.

The oligonucleotides of the invention as optimized for the purpose of targeted alteration of genetic material, including gene knockout or repair, are different in structure from antisense oligonucleotides that may possess a similar mixed chemical composition backbone. The oligonucleotides of the invention differ from such antisense oligonucleotides in chemical composition, structure, sequence, and in their ability to alter genomic DNA. Significantly, antisense oligonucleotides fail to direct targeted gene alteration. The oligonucleotides of the invention may target either the Watson or the Crick strand of DNA and can include any component of the genome including, for example, intron and exon sequences. The preferred embodiment of the invention is a modified oligonucleotide that binds to the non-transcribed strand of a genomic DNA duplex. In other words, the preferred oligonucleotides of the invention target the sense strand of the DNA, i.e. the oligonucleotides of the invention are complementary to the non-transcribed strand of the target duplex DNA. The sequence of the non-transcribed strand of a DNA duplex is found in the mRNA produced from that duplex, given that mRNA uses uracil-containing nucleotides in place of thymine-containing nucleotides.

Moreover, the initial observation that single-stranded oligonucleotides comprising these modifications and lacking any particular triplex forming domain have reproducibly enhanced gene repair activity in a variety of assay systems as compared to a chimeric RNA-DNA double-stranded hairpin control or single-stranded oligonucleotides comprising other backbone modifications was surprising. The single-stranded molecules of the invention totally lack the complementary RNA binding structure that stabilizes a normal chimeric double-stranded hairpin of the type disclosed in U.S. Pat. No. 5,565,350 yet is more effective in producing targeted base conversion as compared to such a chimeric RNA-DNA double-stranded hairpin. In addition, the molecules of the invention lack any particular triplex forming domain involved in Hoogsteen interactions with the DNA double helix and required by other known oligonucleotides in other oligonucleotide dependant gene conversion systems. Although the lack of these functional domains was expected to decrease the efficiency of an alteration in a sequence, just the opposite occurs: the efficiency of sequence alteration using the modified oligonucleotides of the invention is higher than the efficiency of sequence alteration using a chimeric RNA-DNA hairpin targeting the same sequence alteration. Moreover, the efficiency of sequence alteration or gene conversion directed by an unmodified oligonucleotide is many times lower as compared to a control chimeric RNA-DNA molecule or the modified oligonucleotides of the invention targeting the same sequence alteration. Similarly, molecules containing at least 3 2'-O-methyl base analogs are about four to five fold less efficient as compared to an oligonucleotide having the same number of phosphorothioate linkages.

The oligonucleotides of the present invention for alteration of a single base are about 17 to about 121 nucleotides in length, preferably about 17 to about 74 nucleotides in length. Most preferably, however, the oligonucleotides of the present invention are at least about 25 bases in length, unless there are self-dimerization structures within the oligonucleotide. If the oligonucleotide has such an unfavorable structure, lengths longer than 35 bases are preferred. Oligonucleotides with modified ends both shorter and longer than certain of the exemplified, modified oligonucleotides herein function as gene repair or gene knockout agents and are within the scope of the present invention.

Once an oligomer is chosen, it can be tested for its tendency to self-dimerize, since self-dimerization may result in reduced efficiency of alteration of genetic information. Checking for self-dimenzation tendency can be accomplished manually or, more preferably, by using a software program. One such program is Oligo Analyzer 2.0, available through Integrated DNA Technologies (Coralville, Iowa 52241); this program is available for use on the world wide web at the Integrated DNA Technologies web site.

For each oligonucleotide sequence input into the program, Oligo Analyzer 2.0 reports possible seif-dimerized duplex forms, which are usually only partially duplexed, along with the free energy change associated with such self-dimerization. Delta G-values that are negative and large in magnitude, indicating strong seif-dimerization potential, are automatically flagged by the software as "bad". Another software program that analyzes oligomers for pair dimer formation is Primer Select from DNASTAR, Inc., 1228 S. Park St., Madison, Wis. 53715, Phone: (608) 258-7420

If the sequence is subject to significant self-dimerization, the addition of further sequence flanking the "repair" nucleotide can improve gene correction frequency.

Generally, the oligonucleotides of the present invention are identical in sequence to one strand of the target DNA, which can be either strand of the target DNA, with the exception of one or more targeted bases positioned within the DNA domain of the oligonucleotide, and preferably toward the middle between the modified terminal regions. Preferably, the difference in sequence of the oligonucleotide as compared to the targeted genomic DNA is located at about the middle of the oligonucleotide sequence. In a preferred embodiment, the oligonucleotides of the invention are complementary to the non-transcribed strand of a duplex. In other words, the preferred oligonucleotides target the sense strand of the DNA, i.e. the oligonucleotides of the invention are preferably complementary to the strand of the target DNA the sequence of which is found in the mRNA.

The oligonucleotides of the invention can include more than a single base change. In an oligonucleotide that is about a 70-mer, with at least one modified residue incorporated on the ends, as disclosed herein, multiple bases can be simultaneously targeted for change. The target bases may be up to 27 nucleotides apart and may not be changed together in all resultant plasmids in all cases. There is a frequency distribution such that the closer the target bases are to each other in the central DNA domain within the oligonucleotides of the invention, the higher the frequency of change in a given cell. Target bases only two nucleotides apart are changed together in every case that has been analyzed. The farther apart the two target bases are, the less frequent the simultaneous change. Thus, oligonucleotides of the invention may be used to repair or alter multiple bases rather than just one single base. For example, in a 74-mer oligonucleotide having a central base targeted for change, a base change event up to about 27 nucleotides away can also be effected. The positions of the altering bases within the oligonucleotide can be optimized using any one of the assays described herein. Preferably, the altering bases are at least about 8 nucleotides from one end of the oligonucleotide.

The oligonucleotides of the present invention can be introduced into cells by any suitable means. According to certain preferred embodiments, the modified oligonucleotides may be used alone. Suitable means, however, include the use of polycations, cationic lipids, liposomes, polyethylenimine (PEI), electroporation, biolistics, microinjecton and other methods known in the art to facilitate cellular uptake. According to certain preferred embodiments of the present invention, the isolated cells are treated in culture according to the methods of the invention, to mutate or repair a target gene. Modified cells may then be reintroduced into the organism as, for example, in bone marrow having a targeted gene. Alternatively, modified cells may be used to regenerate the whole organism as, for example, in a plant having a desired targeted genomic change. In other instances, targeted genomic alteration, including repair or mutagenesis, may take place in vivo following direct administration of the modified, single-stranded oligonucleotides of the invention to a subject.

The single-stranded, modified oligonucleotides of the present invention have numerous applications as gene repair, gene modification, or gene knockout agents. Such oligonucleotides may be advantageously used, for example, to introduce or correct multiple point mutations. Each mutation leads to the addition, deletion or substitution of at least one base pair. The methods of the present invention offer distinct advantages over other methods of altering the genetic makeup of an organism, in that only the individually targeted bases are altered. No additional foreign DNA sequences are added to the genetic complement of the organism. Such agents may, for example, be used to develop plants or animals with improved traits by rationally changing the sequence of selected genes in cultured cells. Modified cells are then cloned into whole plants or animals having the altered gene. See, e.g., U.S. Pat. No. 6,046,380 and U.S. Pat. No. 5,905,185 incorporated herein by reference. Such plants or animals produced using the compositions of the invention lack additional undesirable selectable markers or other foreign DNA sequences. Targeted base pair substitution or frameshift mutations introduced by an oligonucleotide in the presence of a cell-free extract also provides a way to modify the sequence of extrachromosomal elements, including, for example, plasmids, cosmids and artificial chromosomes. The oligonucleotides of the invention also simplify the production of transgenic animals having particular modified or inactivated genes. Altered animal or plant model systems such as those produced using the methods and oligonucleotides of the invention are invaluable in determining the function of a gene and in evaluating drugs. The oligonucleotides and methods of the present invention may also be used for gene therapy to correct mutations causative of human diseases.

The purified oligonucleotide compositions may be formulated in accordance with routine procedures as a pharmaceutical composition adapted for bathing cells in culture, for microinjecton into cells in culture, and for intravenous administration to human beings or animals. Typically, compositions for cellular administration or for intravenous administration into animals, including humans, are solutions in sterile isotonic aqueous buffer. Where necessary, the composition may also include a solubilizing agent and a local anaesthetic such as lignocaine to ease pain at the site of the injection. Generally, the ingredients will be supplied either separately or mixed together in unit dosage form, for example, as a dry, lyophilized powder or water-free concentrate. The composition may be stored in a hermetically sealed container such as an ampule or sachette indicating the quantity of active agent in activity units. Where the composition is administered by infusion, it can be dispensed with an infusion bottle containing sterile pharmaceutical grade "water for injection" or saline. Where the composition is to be administered by injection, an ampule of sterile water for injection or saline may be provided so that the ingredients may be mixed prior to administration.

Pharmaceutical compositions of this invention comprise the compounds of the present invention and pharmaceutically acceptable salts thereof, with any pharmaceutically acceptable ingredient, excipient, carrier, adjuvant or vehicle.

The oligonucleotides of the invention are preferably administered to the subject in the form of an injectable composition. The composition is preferably administered parenterally, meaning intravenously, intraarterially, intrathecally, interstitially or intracavitarilly. Pharmaceutical compositions of this invention can be administered to mammals including humans in a manner similar to other diagnostic or therapeutic agents. The dosage to be administered, and the mode of administration will depend on a variety of factors including age, weight, sex, condition of the subject and genetic factors, and will ultimately be decided by medical personnel subsequent to experimental determinations of varying dosage as described herein. In general, dosage required for correction and therapeutic efficacy will range from about 0.001 to 50,000 µg/kg, preferably between 1 to 250 µg/kg of host cell or body mass, and most preferably at a concentration of between 30 and 60 micromolar.

For cell administration, direct injection into the nucleus, biolistic bombardment, electroporation, liposome transfer and calcium phosphate precipitation may be used. In yeast, lithium acetate or spheroplast transformation may also be used. In a preferred method, the administration is performed with a liposomal transfer compound, e.g., DOTAP (Boehringer-Mannheim) or an equivalent such as lipofectin. The amount of the oligonucleotide used is about 500 nanograms in 3 micrograms of DOTAP per 100,000 cells. For electroporation, between 20 and 2000 nanograms of oligonucleotide per million cells to be electroporated is an appropriate range of dosages which can be increased to improve efficiency of genetic alteration upon review of the appropriate sequence according to the methods described herein.

Another aspect of the invention is a kit comprising at least one oligonucleotide of the invention. The kit may comprise an addition reagent or article of manufacture. The additional reagent or article of manufacture may comprise a cell extract, a cell, or a plasmid, such as one of those disclosed in the Figures herein, for use in an assay of the invention.

BRIEF DESCRIPTION OF THE DRAWINGS

In FIG. 1(D), the Kan mutant sequence corresponds to SEQ ID NO:4343 and SEQ ID NO:4344: the Kan converted sequence corresponds to SEQ ID NO:4345 and SEQ ID NO:4346; the mutant sequence in the sequence trace corresponds to SEQ ID NO:4347 and the converted sequences in the sequence trace correspond to SEQ ID NO:4348.

FIG. 7. Hygromycin-eGFP target plasmids. (A) Plasmid pAlJRHYG(ins)GFP contains a single base insertion mutation between nucleotides 136 and 137, at codon 46, of the Hygromycin B coding sequence (cds) which is transcribed from the constitutive ADH1 promoter. The target sequence presented below indicates the deletion of an A and the substitution of a C for a T directed by the oligonucleotides to re-establish the resistant phenotype.

In FIG. 8, the sequence of HygE3T/25 corresponds to SEQ ID NO:4363, the sequence of HygE3T/74 corresponds to SEQ ID NO:4364, the sequence of HygE3T/74a corresponds to SEQ ID NO:4365, the sequence of HygGG/Rev corresponds to SEQ ID NO:4366 and the sequence of Kan70T corresponds to SEQ ID NO:4367.

In FIG. 9, the sequence of the Neo/kan target mutant corresponds to SEQ ID NO:4343 and SEQ ID NO:4344, the converted sequence corresponds to SEQ ID NO:4345 and SEQ ID NO:4346 and the FlAsH peptide sequence corresponds to SEQ ID NO:4367.

The following examples are provided by way of illustration only, and are not intended to limit the scope of the invention disclosed herein.

EXAMPLE 1

Assay Method for Base Alteration and Preferred Oligonucleotide Selection

Figure 2:
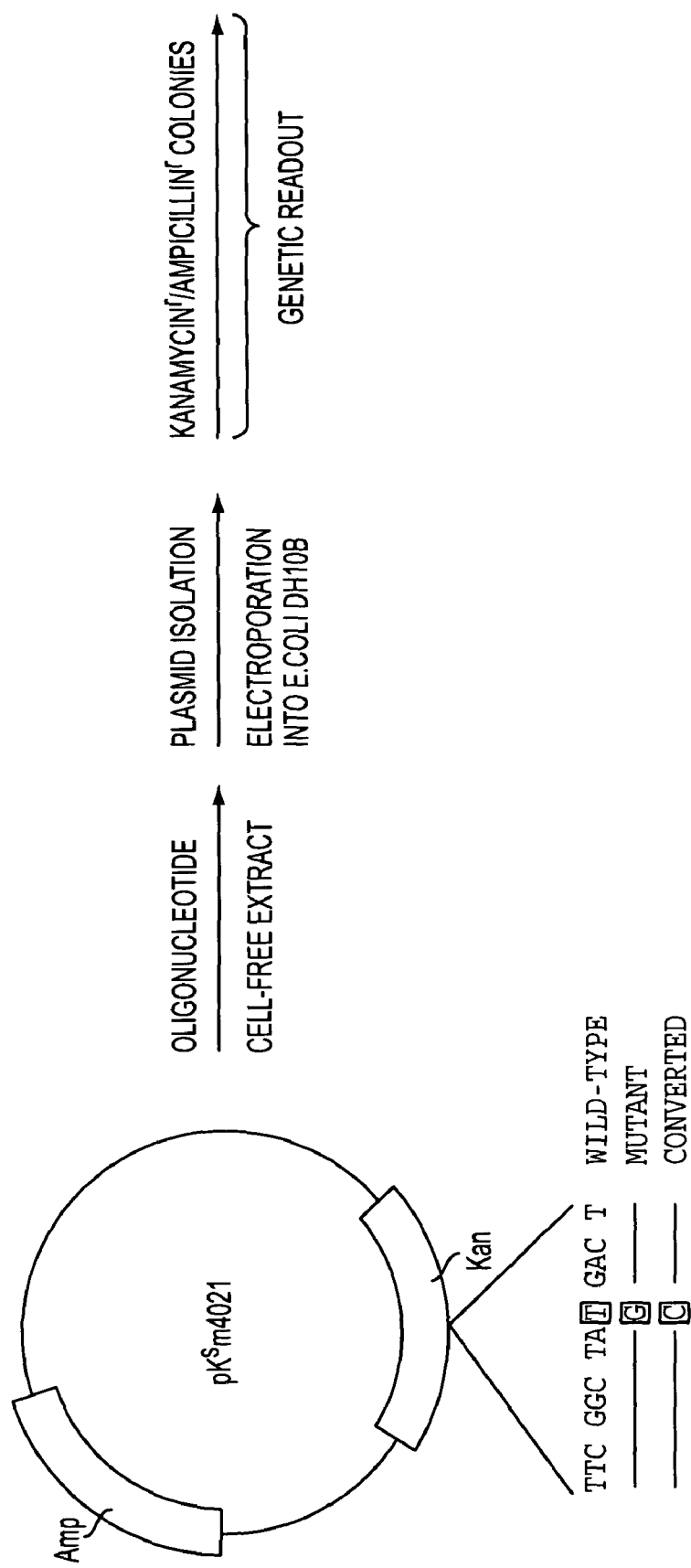
FIG. 2. Genetic readout system for correction of a point mutation in plasmid $pK^sm4021$. A mutant kanamycin gene harbored in plasmid $pK^sm4021$ is the target for correction by oligonucleotides. The mutant G is converted to a C by the action of the oligo. Corrected plasmids confer resistance to kanamycin in *E.coli* (DH10B) after electroporation leading to the genetic readout and colony counts. The wild type sequence corresponds to SEQ ID NO:4349.
Figure 3:
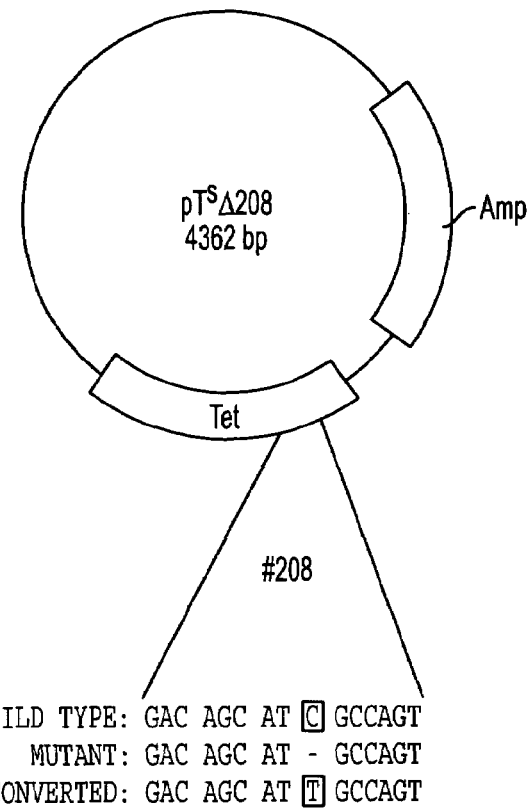
FIG. 3. Target plasmid and sequence correction of a frameshift mutation by chimeric and single-stranded oligonucleotides. (A) Plasmid $pT^s\Delta208$ contains a single base deletion mutation at position 208 rendering it unable to confer tet resistance. The target sequence presented below indicates the insertion of a T directed by the oligonucleotides to re-establish the resistant phenotype. (B) DNA sequence confirming base insertion directed by Tet 3S/25G; the yellow highlight indicates the position of frame shift repair. The wild type sequence corresponds to SEQ ID NO:4350, the mutant sequence corresponds to SEQ ID NO:4351 and the converted sequence corresponds to SEQ ID NO:4352. The control sequence in the sequence trace corresponds to SEQ ID NO:4353 and the 3S/25A sequence in the sequence trace corresponds to SEQ ID NO:4354.
Figure 3:
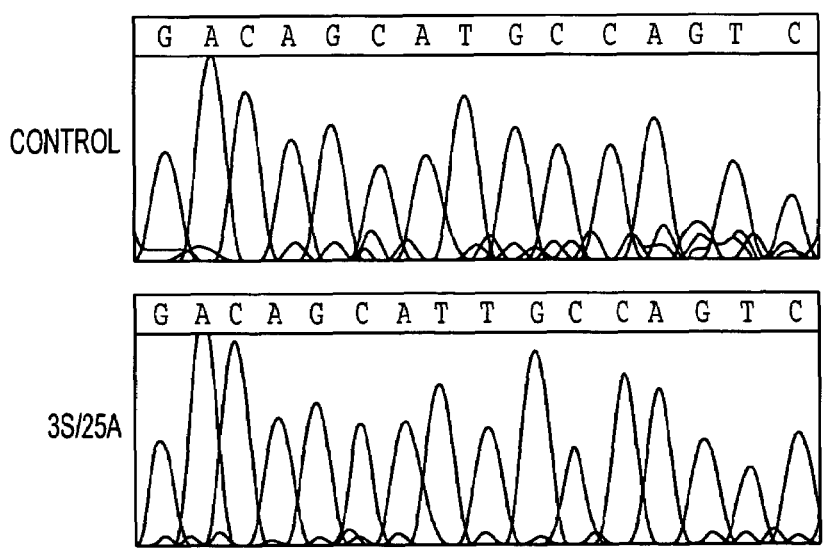
Figure 9:
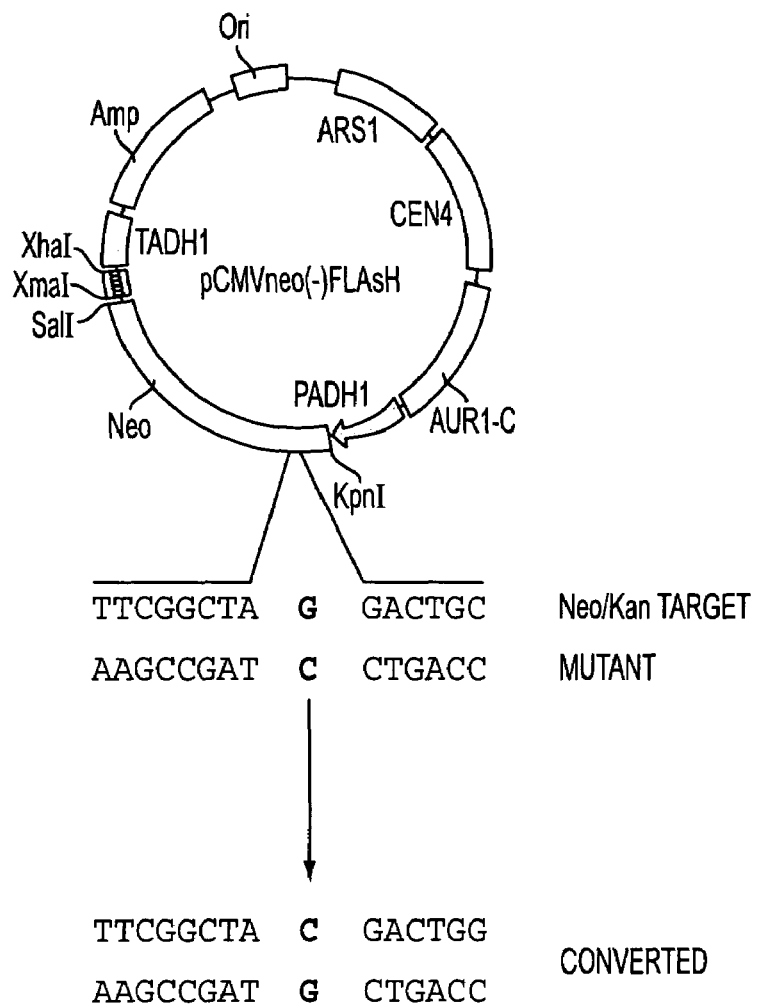
FIG. 9. pAURNeo(–)FlAsH plasmid. This figure describes the plasmid structure, target sequence, oligonucleotides, and the basis for detection of the gene alteration event by fluorescence.
Figure 9:
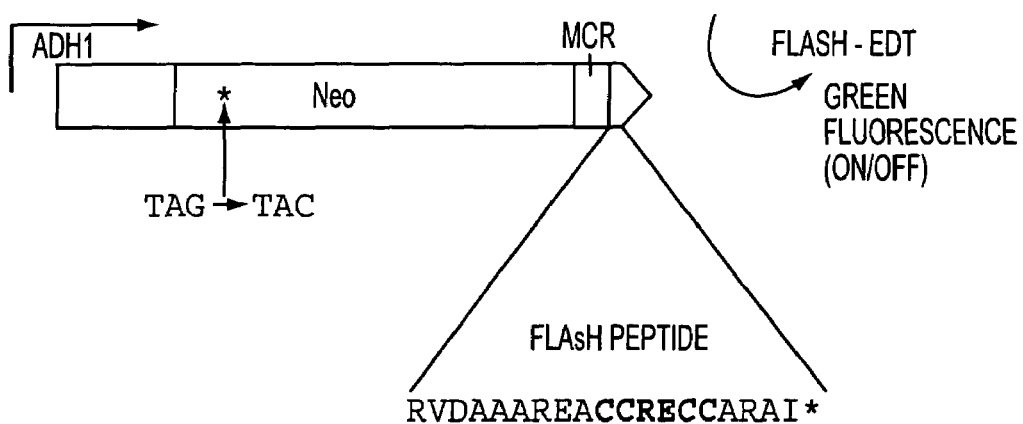

In this example, single-stranded and double-hairpin oligonucleotides with chimeric backbones (see FIG. 1 for structures (A and B) and sequences (C and D) of assay oligonucleotides) are used to correct a point mutation in the kanamycin gene of pK$^s$m4021 (FIG. 2) or the tetracycline gene of pT$^s$Δ208 (FIG. 3). All kan oligonucleotides share the same 25 base sequence surrounding the target base identified for change, just as all tet oligonucleotides do. The sequence is given in FIG. 1C and FIG. 1D. Each plasmid contains a functional ampicillin gene. Kanamycin gene function is restored when a G at position 4021 is converted to a C (via a substitution mutation); tetracycline gene function is restored when a deletion at position 208 is replaced by a C (via frameshift mutation). A separate plasmid, pAURNeo(–)FlAsH (FIG. 9), bearing the kan$^s$ gene is used in the cell culture experiments. This plasmid was constructed by inserting a synthetic expression cassette containing a neomycin phosphotransferase (kanamycin resistance) gene and an extended reading frame that encodes a receptor for the FlAsH ligand into the pAUR123 shuttle vector (Panvera Corp., Madison, Wis.). The resulting construct replicates in *S. cerevisiae* at low copy number, confers resistance to aureobasidinA and constitutively expresses either the Neo+/FlAsH fusion product (after alteration) or the truncated Neo–/FlAsH product (before alteration) from the ADH1 promoter. By extending the reading frame of this gene to code for a unique peptide sequence capable of binding a small ligand to form a fluorescent complex, restoration of expression by correction of the stop codon can be detected in real time using confocal microscopy. Additional constructs can be made to test additional gene alteration events.

We also construct three mammalian expression vectors, pHyg(rep)eGFP, pHyg(Δ)eGFP, pHyg(ins)eGFP, that contain a substitution mutation at nucleotide 137 of the hygromycin-B coding sequence. (rep) indicates a T137→G replacement, (Δ) represents a deletion of the G137 and (ins) represents an A insertion between nucleotides 136 and 137. All point mutations create a nonsense termination codon at residue 46. We use pHygEGFP plasmid (Invitrogen, CA) DNA as a template to introduce the mutations into the hygromycin-eGFP fusion gene by a two step site-directed mutagenesis PCR protocol. First, we generate overlapping 5' and a 3' amplicons surrounding the mutation site by PCR for each of the point mutation sites. A 215 bp 5' amplicon for the (rep), (Δ) or (ins) was generated by polymerization from oligonucleotide primer HygEGFPf (5'-AATACGACTCAC-TATAGG-3'; SEQ ID NO:4369) to primer Hygrepr (5'GAC-CTATCCACGCCCTCC-3': SEQ ID NO:4370), HygΔr (5'-GACTATCCACGCCCTCC-3'; SEQ ID NO:4371), or Hyginsr (5'-GACATTATCCACGCCCTCC-3α; SEQ ID NO:4372), respectively. We generate a 300 bp 3' amplicon for the (rep), (Δ) or (ins) by polymerization from oligonucleotide primers Hygrepf (5'-CTGGGATAGGTCCTGCGG-3'; SEQ ID NO:4373), HygΔf(5'-CGTGGATAGTCCTGCGG-3+; SEQ ID NO:4374), Hyginsf (5'-CGTGGATAATGTC-CTGCGG-3'; SEQ ID NO:4375), respectively to primer HygEGFPr (5'-AAATCACGCCATGTAGTG-3'; SEQ ID NO:4376). We mix 20 ng of each of the resultant 5' and 3' overlapping amplicon mutation sets and use the mixture as a template to amplify a 523 bp fragment of the Hygromycin gene spanning the KpnI and RsrII restriction endonuclease sites. We use the Expand PCR system (Roche) to generate all amplicons with 25 cycles of denaturing at 94° C. for 10 seconds, annealing at 55° C. for 20 seconds and elongation at 68° C. for 1 minute. We digest 10 μg of vector pHygEGFP and 5 μg of the resulting fragments for each mutation with KpnI and RsrII (NEB) and gel purify the fragment for enzymatic ligation. We ligate each mutated insert into pHygEGFP vector at 3:1 molar ration using T4 DNA ligase (Roche). We screen clones by restriction digest, confirm the mutation by Sanger dideoxy chain termination sequencing and purify the plasmid using a Qiagen maxiprep kit.

Oligonucleotide synthesis and cells. Chimeric oligonucleotides and single-stranded oligonucleotides (including those with the indicated modifications) are synthesized using available phosphoramidites on controlled pore glass supports. After deprotecton and detachment from the solid support, each oligonucleotide is gel-purified using, for example, procedures such as those described in Gamper et al., *Biochem*. 39, 5808-5816 (2000) and the concentrations determined spectrophotometrically (33 or 40 μg/ml per $A_{260}$ unit of single-stranded or hairpin oligomer). HUH7 cells are grown in DMEM, 10% FBS, 2 mM glutamine, 0.5% pen/strep. The *E.coli* strain, DH10B, is obtained from Life Technologies (Gaithersburg, Md.); DH10B cells contain a mutation in the RECA gene (recA).

Cell-free extracts. We prepare cell-free extracts from HUH7 cells or other mammalian cells, as follows. We employ this protocol with essentially any mammalian cell including, for example, H1299 cells (human epithelial carcinoma, non-small cell lung cancer), C127I (immortal murine mammary epithelial cells), MEF (mouse embryonic fibroblasts), HEC-1-A (human uterine carcinoma), HCT15 (human colon cancer), HCT116 (human colon carcinoma), LoVo (human colon adenocarcinoma), and HeLa (human cervical carcinoma). We harvest approximately $2\times10^8$ cells. We then wash the cells immediately in cold hypotonic buffer (20 mM HEPES, pH7.5; 5 mM KCl; 1.5 mM $MgCl_2$; 1 mM DTT) with 250 mM sucrose. We then resuspend the cells in cold hypotonic buffer without sucrose and after 15 minutes we lyse the cells with 25 strokes of a Dounce homogenizer using a tight fitting pestle. We incubate the lysed cells for 60 minutes on ice and centrifuge the sample for 15 minutes at 12000×g. The cytoplasmic fraction is enriched with nuclear proteins due to the extended co-incubation of the fractions following cell breakage. We then immediately aliquote and freeze the supernatant at −80° C. We determine the protein concentration in the extract by the Bradford assay.

We also perform these experiments with cell-free extracts obtained from fungal cells, including, for example, *S. cerevisiae* (yeast), *Ustilago maydis*, and *Candida albicans*. For example, we grow yeast cells into log phase in 2L YPD medium for 3 days at 30° C. We then centrifuge the cultures at 5000×g, resuspend the pellets in a 10% sucrose, 50 mM Tris, 1 mM EDTA lysis solution and freeze them on dry ice. After thawing, we add KCl, spermidine and lyticase to final concentrations of 0.25 mM, 5 mM and 0.1 mg/ml, respectively. We incubate the suspension on ice for 60 minutes, add PMSF and Triton X100 to final concentrations of 0.1 mM and 0.1% and continue to incubate on ice for 20 minutes. We centrifuge the lysate at 3000×g for 10 minutes to remove larger debris. We then remove the supernatant and clarify it by centrifuging at 30000×g for 15 minutes. We then add glycerol to the clarified extract to a concentration of 10% (v/v) and freeze aliquots at −80° C. We determine the protein concentration of the extract by the Bradford assay.

Reaction mixtures of 50 μl are used, consisting of 10-30 μg protein of cell-free extract, which can be optionally substituted with purified proteins or enriched fractions, about 1.5 μg chimeric double-hairpin oligonucleotide or 0.55 μg single-stranded molecule (3S/25G or 6S/25G, see FIG. 1), and 1 μg of plasmid DNA (see FIGS. 2 and 3) in a reaction buffer of 20 mM Tris, pH 7.4, 15 mM $MgCl_2$, 0.4 mM DTT, and 1.0 mM ATP. Reactions are initiated with extract and incubated at 30° C. for 45 min. The reaction is stopped by placing the tubes on ice and then immediately deproteinized by two phenol/chloroform (1:1) extractions. Samples are then ethanol precipitated. The nucleic acid is pelleted at 15,000 r.p.m. at 4° C. for 30 min., is washed with 70% ethanol, resuspended in 50 μl $H_2O$, and is stored at −20° C. 5 μl of plasmid from the resuspension (~100 ng) was transfected in 20 μl of DH10B cells by electroporation (400 V, 300 μF, 4 kΩ) in a Cell-Porator apparatus (Life Technologies). After electroporation, cells are transferred to a 14 ml Falcon snap-cap tube with 2 ml SOC and shaken at 37° C. for 1 h. Enhancement of final kan colony counts is achieved by then adding 3 ml SOC with 10 μg/ml kanamycin and the cell suspension is shaken for a further 2 h at 37° C. Cells are then spun down at 3750×g and the pellet is resuspended in 500 μl SOC. 200 μl is added undiluted to each of two kanamycin (50 μg/ml) agar plates and 200 μl of a $10^5$ dilution is added to an ampicillin (100 μg/ml) plate. After overnight 37° C. incubation, bacterial colonies are counted using an Accucount 1000 (Biologics). Gene conversion effectiveness is measured as the ratio of the average of the kan colonies on both plates per amp colonies multiplied by $10^{-5}$ to correct for the amp dilution.

The following procedure can also be used. 5 μl of resuspended reaction mixtures (total volume 50 μl) are used to transform 20 μl aliquots of electro-competent ΔH10B bacteria using a Cell-Porator apparatus (Life Technologies). The mixtures are allowed to recover in 1 ml SOC at 37° C. for 1 hour at which time 50 μg/ml kanamycin or 12 μg/ml tetracycline is added for an additional 3 hours. Prior to plating, the bacteria are pelleted and resuspended in 200 μl of SOC. 100 µl aliquots are plated onto kan or tet agar plates and 100 µl of a $10^{-4}$ dilution of the cultures are concurrently plated on agar plates containing 100 µg/ml of ampicillin. Plating is performed in triplicate using sterile Pyrex beads. Colony counts are determined by an Accu-count 1000 plate reader (Biologics). Each plate contains 200-500 ampicillin resistant colonies or 0-500 tetracycline or kanamycin resistant colonies. Resistant colonies are selected for plasmid extraction and DNA sequencing using an ABI Prism kit on an ABI 310 capillary sequencer (PE Biosystems).

Chimeric single-stranded oligonucleotides. In FIG. 1 the upper strands of chimeric oligonucleotides I and II are separated into pathways resulting in the generation of single-stranded oligonucleotides that contain (FIG. 1A) 2'-O-methyl RNA nucleotides or (FIG. 1B) phosphorothioate linkages. Fold changes in repair activity for correction of $kan^s$ in the HUH7 cell-free extract are presented in parenthesis. Each single-stranded oligonucleotide is 25 bases in length and contains a G residue mismatched to the complementary sequence of the $kan^s$ gene.

Figure 1A:
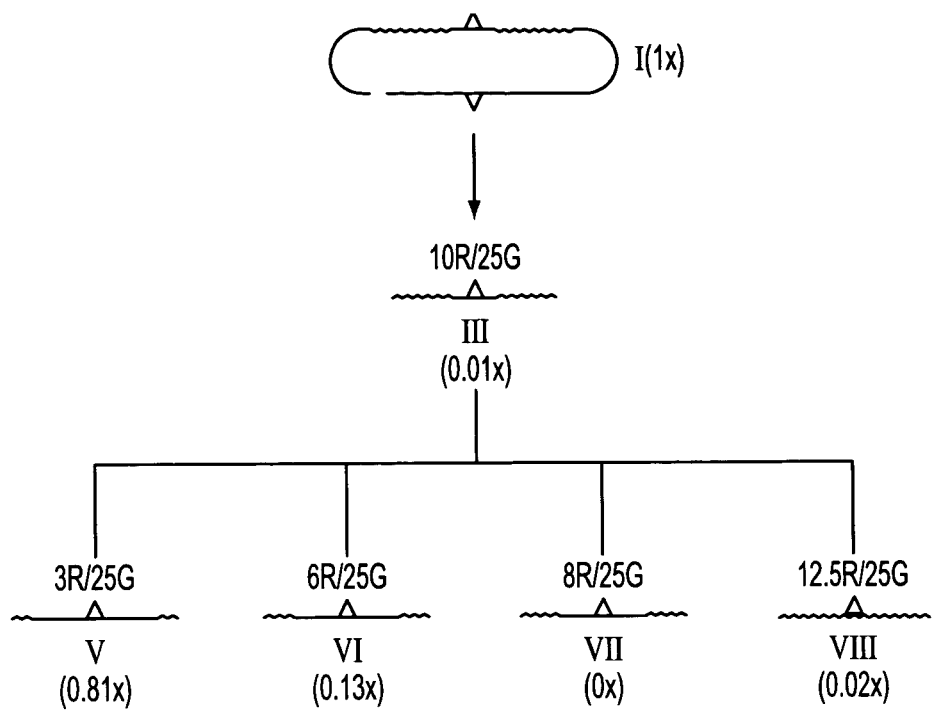
FIG. 1. Flow diagram for the generation of modified single-stranded oligonucleotides. The upper strands of chimeric oligonucleotides I and II are separated into pathways resulting in the generation of single-stranded oligonucleotides that contain (A) 2'-O-methyl RNA nucleotides or (B) phosphorothioate linkages. Fold changes in repair activity for correction of $kan^s$ in the HUH7 cell-free extract are presented in parenthesis. HUH-7 cells are described in Nakabayashi et al., Cancer Research 42: 3858-3863 (1982). Each single-stranded oligonucleotide is 25 bases in length and contains a G residue mismatched to the complementary sequence of the $kan^s$ gene. The numbers 3, 6, 8, 10, 12 and 12.5 respectively indicate how many phosphorothioate linkages (S) or 2'-O-methyl RNA nucleotides (R) are at each end of the molecule. Hence oligo 12S/25G contains an all phosphorothioate backbone, displayed as a dotted line. Smooth lines indicate DNA residues, wavy lines indicate 2'-O-methyl RNA residues and the carat indicates the mismatched base site (G).
FIG. 1(C) provides a schematic plasmid indicating the sequence of the kan chimeric double-stranded hairpin oligonucleotide (left; SEQ ID NO:4341) and the sequence the tet chimeric double-stranded hairpin oligonucleotide used in other experiments (SEQ ID NO:4342).
FIG. 1(D) provides a flow chart of a kan experiment in which a chimeric double-stranded hairpin oligonucleotide (SEQ ID NO:4341) is used.
Figure 1B:
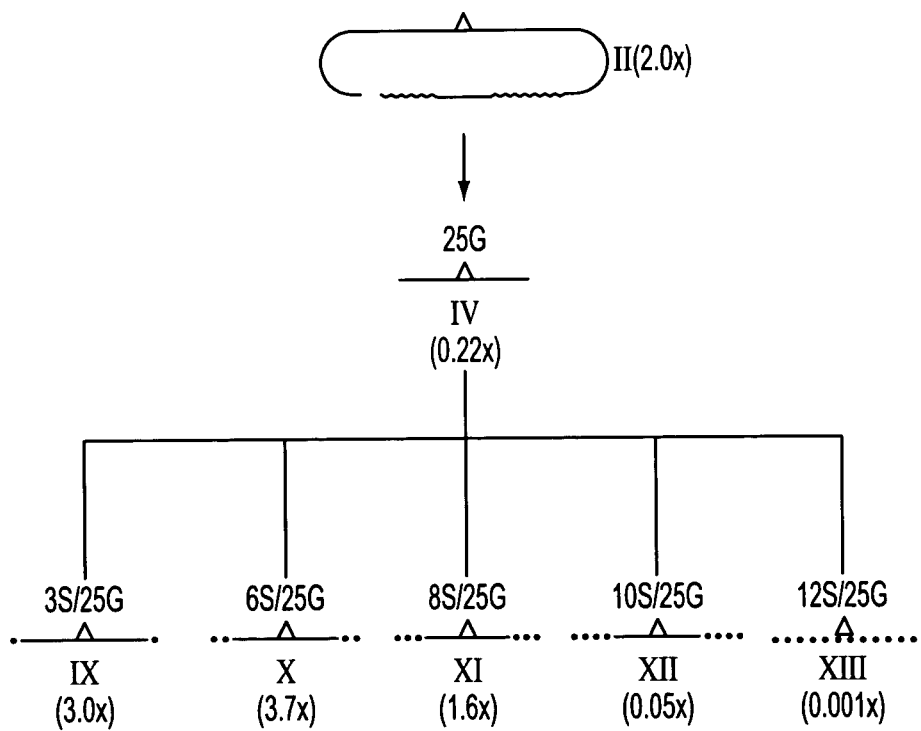
Figure 1C:
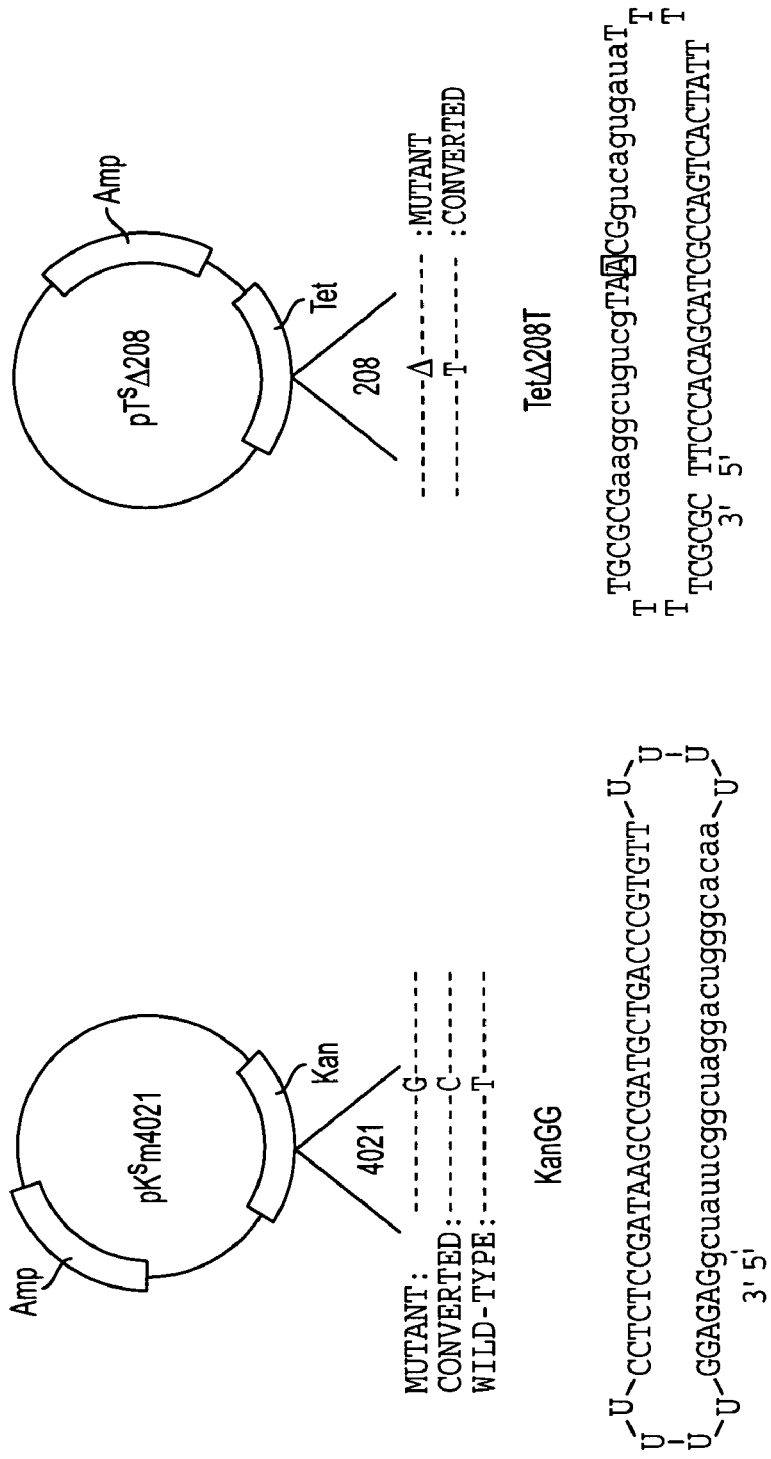
Figure 1D:
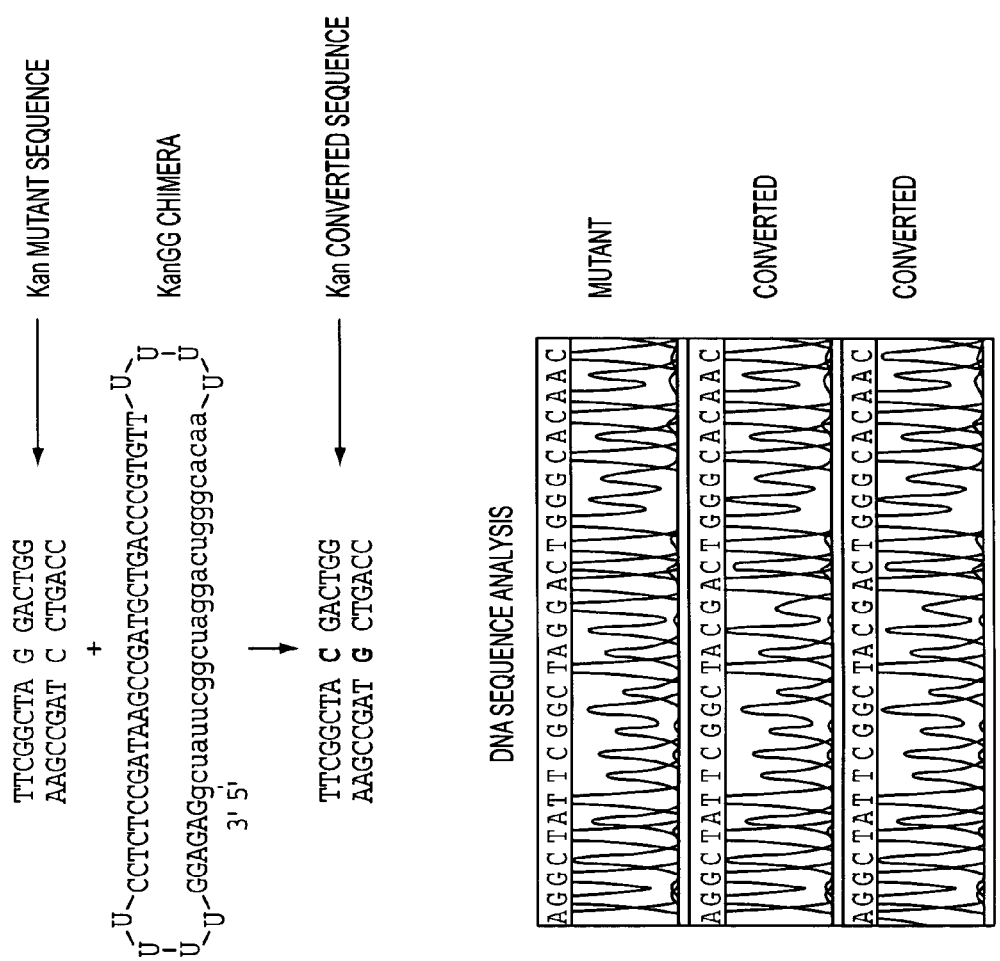

Molecules bearing 3, 6, 8, 10 and 12 phosphorothioate linkages in the terminal regions at each end of a backbone with a total of 24 linkages (25 bases) are tested in the $kan^s$ system. Alternatively, molecules bearing 2, 4, 5, 7, 9 and 11 in the terminal regions at each end are tested. The results of one such experiment, presented in Table 1 and FIG. 1B, illustrate an enhancement of correction activity directed by some of these modified structures. In this illustrative example, the most efficient molecules contained 3 or 6 phosphorothioate linkages at each end of the 25-mer; the activities are approximately equal (molecules IX and X with results of 3.09 and 3.7 respectively). A reduction in alteration activity may be observed as the number of modified linkages in the molecule is further increased. Interestingly, a single-strand molecule containing 24 phosphorothioate linkages is minimally active suggesting that this backbone modification when used throughout the molecule supports only a low level of targeted gene repair or alteration. Such a non-altering, completely modified molecule can provide a baseline control for determining efficiency of correction for a specific oligonucleotide molecule of known sequence in defining the optimum oligonucleotide for a particular alteration event.

The efficiency of gene repair directed by phosphorothioate-modified, single-stranded molecules, in a length dependent fashion, led us to examine the length of the RNA modification used in the original chimera as it relates to correction. Construct III represents the "RNA-containing" strand of chimera I and, as shown in Table 1 and FIG. 2A, it promotes inefficient gene repair. But, as shown in the same figure, reducing the RNA residues on each end from 10 to 3 increases the frequency of repair. At equal levels of modification, however, 25-mers with 2'-O-methyl ribonucleotides were less effective gene repair agents than the same oligomers with phosphorothioate linkages. These results reinforce the fact that an RNA containing oligonucleotide is not as effective in promoting gene repair or alteration as a modified DNA oligonucleotide.

Figure 4:
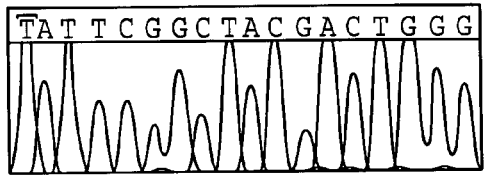
FIG. 4. DNA sequences of representative kan$^r$ colonies. Confirmation of sequence alteration directed by the indicated molecule is presented along with a table outlining codon distribution. Note that 10S/25G and 12S/25G elicit both mixed and unfaithful gene repair. The number of clones sequenced is listed in parentheses next to the designation for the single-stranded oligonucleotide. A plus (+) symbol indicates the codon identified while a figure after the (+) symbol indicates the number of colonies with a particular sequence. TAC/TAG indicates a mixed peak. Representative DNA sequences are presented below the table with yellow highlighting altered residues. The sequences in the sequence trace have been assigned numbers as follows: 3S/25G, 6S/25G and 8S/25G correspond to SEQ ID NO:4355, 10S/25G corresponds to SEQ ID NO:4356, 25S/25G on the lower left corresponds to SEQ ID NO:4357 and 25S/25G on the lower right corresponds to SEQ ID NO:4358.
Figure 4:
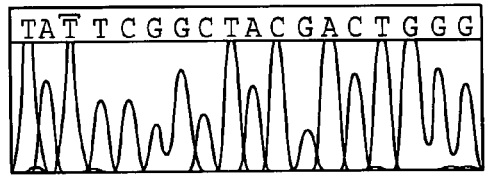
Figure 4:
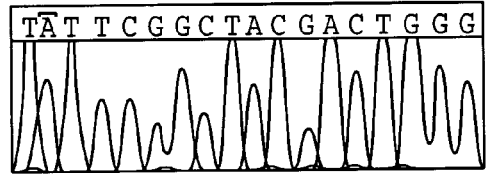
Figure 4:
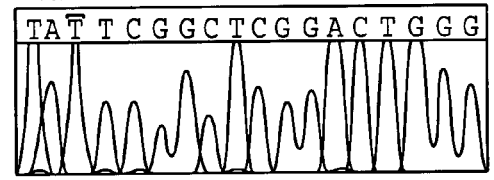
Figure 4:
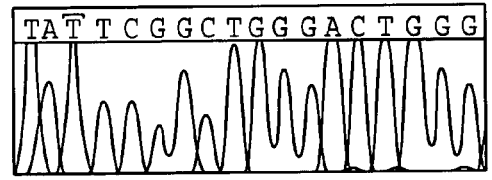
Figure 4:
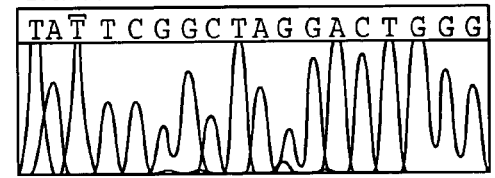

Repair of the kanamycin mutation requires a G→C exchange. To confirm that the specific desired correction alteration was obtained, colonies selected at random from multiple experiments are processed and the isolated plasmid DNA is sequenced. As seen in FIG. 4, colonies generated through the action of the single-stranded molecules 3S/25G (IX), 6S/25G (X) and 8S/25G (XI) respectively contained plasmid molecules harboring the targeted base correction. While a few colonies appeared on plates derived from reaction mixtures containing 25-mers with 10 or 12 thioate linkages on both ends, the sequences of the plasmid molecules from these colonies contain nonspecific base changes. In these illustrative examples, the second base of the codon is changed (see FIG. 3). These results show that modified single-strands can direct gene repair, but that efficiency and specificity are reduced when the 25-mers contain 10 or more phosphorothioate linkages at each end.

In FIG. 1, the numbers 3, 6, 8, 10, 12 and 12.5 respectively indicate how many phosphorothioate linkages (S) or 2'-O-methyl RNA nucleotides (R) are at each end of the exemplified molecule although other molecules with 2, 4, 5, 7, 9 and 11 modifications at each end can also be tested. Hence oligo 12S/25G represents a 25-mer oligonucleotide which contains 12 phosphorothioate linkages on each side of the central G target mismatch base producing a fully phosphorothioate linked backbone, displayed as a dotted line. The dots are merely representative of a linkage in the figure and do not depict the actual number of linkages of the oligonucleotide. Smooth lines indicate DNA residues, wavy lines indicate 2'-O-methyl RNA residues and the carat indicates the mismatched base site (G).

Correction of a mutant kanamycin gene in cultured mammalian cells. The experiments are performed using different mammalian cells, including, for example, 293 cells (transformed human primary kidney cells), HeLa cells (human cervical carcinoma), and H1299 (human epithelial carcinoma, non-small cell lung cancer). HeLa cells are grown at 37° C. and 5% $CO_2$ in a humidified incubator to a density of $2 \times 10^5$ cells/ml in an 8 chamber slide (Lab-Tek). After replacing the regular DMEM with Optimem, the cells are co-transfected with 10 µg of plasmid pAURNeo(⁻)FlAsH and 5 µg of modified single-stranded oligonucleotide (3S/25G) that is previously complexed with 10 µg lipofectamine, according to the manufacturer's directions (Life Technologies). The cells are treated with the liposome-DNA-oligo mix for 6 hrs at 37° C. Treated cells are washed with PBS and fresh DMEM is added. After a 16-18 hr recovery period, the culture is assayed for gene repair. The same oligonucleotide used in the cell-free extract experiments is used to target transfected plasmid bearing the $kan^s$ gene. Correction of the point mutation in this gene eliminates a stop codon and restores full expression. This expression can be detected by adding a small non-fluorescent ligand that bound to a C-C-R-E-C-C (SEQ ID NO:4385) sequence in the genetically modified carboxy terminus of the kan protein, to produce a highly fluorescent complex (FlAsH system, Aurora Biosciences Corporation). Following a 60 min incubation at room temperature with the ligand (FlAsH-EDT2), cells expressing full length kan product acquire an intense green fluorescence detectable by fluorescence microscopy using a fluorescein filter set. Similar experiments are performed using the HygeGFP target as described in Example 2 with a variety of mammalian cells, including, for example, COS-1 and COS-7 cells (African green monkey), and CHO-K1 cells (Chinese hamster ovary). The experiments are also performed with PG12 cells (rat pheocliromocytoma) and ES cells (human embryonic stem cells).

Summary of experimental results. Tables 1, 2 and 3 respectively provide data on the efficiency of gene repair directed by single-stranded oligonucleotides. Table 1 presents data using a cell-free extract from human liver cells (HUH7) to catalyze repair of the point mutation in plasmid pkan$^s$m4021 (see FIG. 1). Table 2 illustrates that the oligomers are not dependent on MSH2 or MSH3 for optimal gene repair activity. Table 3 illustrates data from the repair of a frameshift mutation (FIG. 3) in the tet gene contained in plasmid pTetΔ208. Table 4 illustrates data from repair of the pkan$^s$m4021 point mutation catalyzed by plant cell extracts prepared from canola and musa (banana). Colony numbers are presented as kan$^r$ or te$^t$ and fold increases (single strand versus double hairpin) are presented for kan$^r$ in Table 1.

Figure 5:
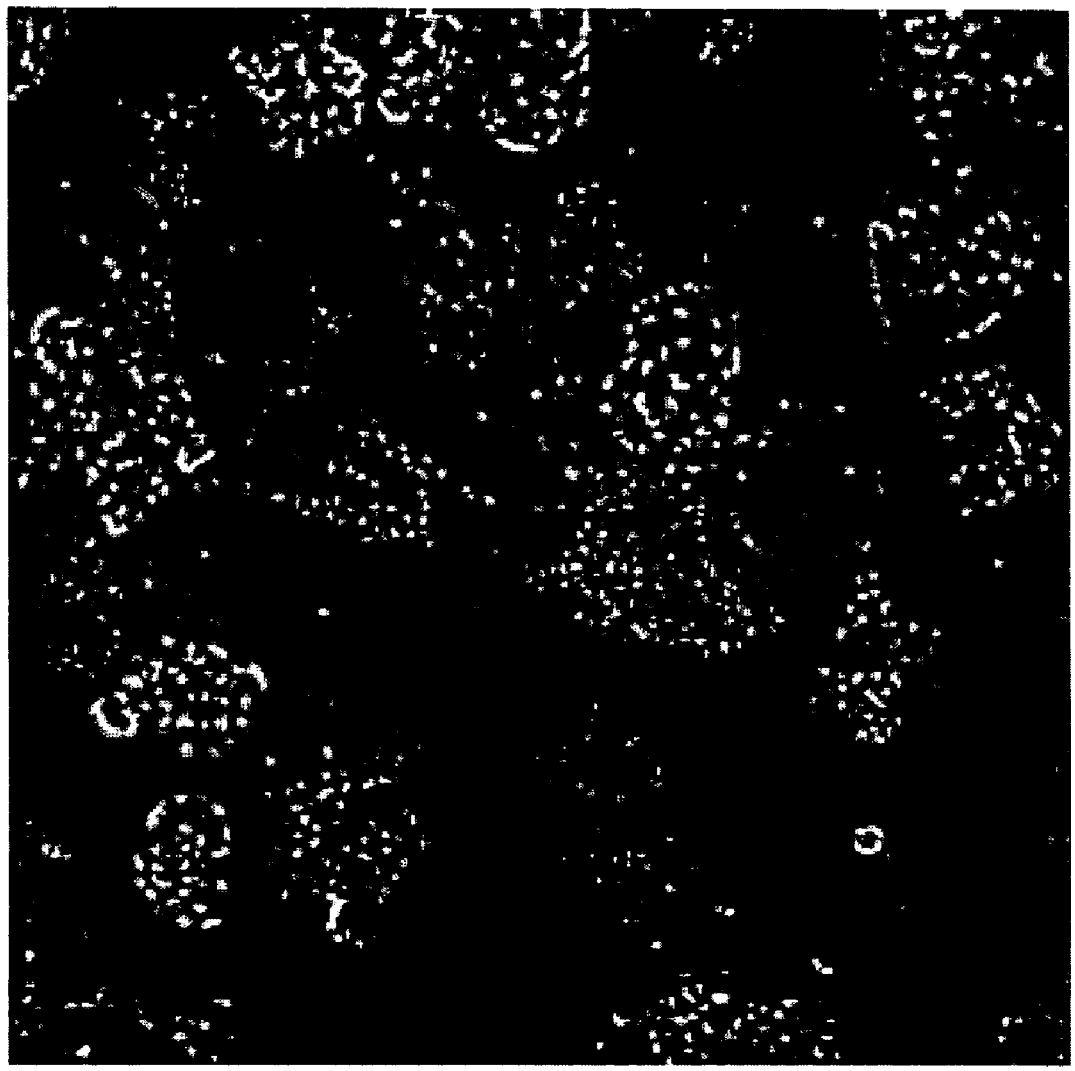
FIG. 5. Gene correction in HeLa cells. Representative oligonucleotides of the invention are co-transfected with the pCMVneo($^-$)FlAsH plasmid (shown in FIG. 9) into HeLa cells. Ligand is diffused into cells after co-transfection of plasmid and oligonucleotides. Green fluorescence indicates gene correction of the mutation in the antibiotic resistance gene. Correction of the mutation results in the expression of a fusion protein that carries a marker ligand binding site and when the fusion protein binds the ligand, a green fluorescence is emitted. The ligand is produced by Aurora Biosciences and can readily diffuse into cells enabling a measurement of corrected protein function; the protein must bind the ligand directly to induce fluorescence. Hence cells bearing the corrected plasmid gene appear green while "uncorrected" cells remain colorless.
Figure 6:
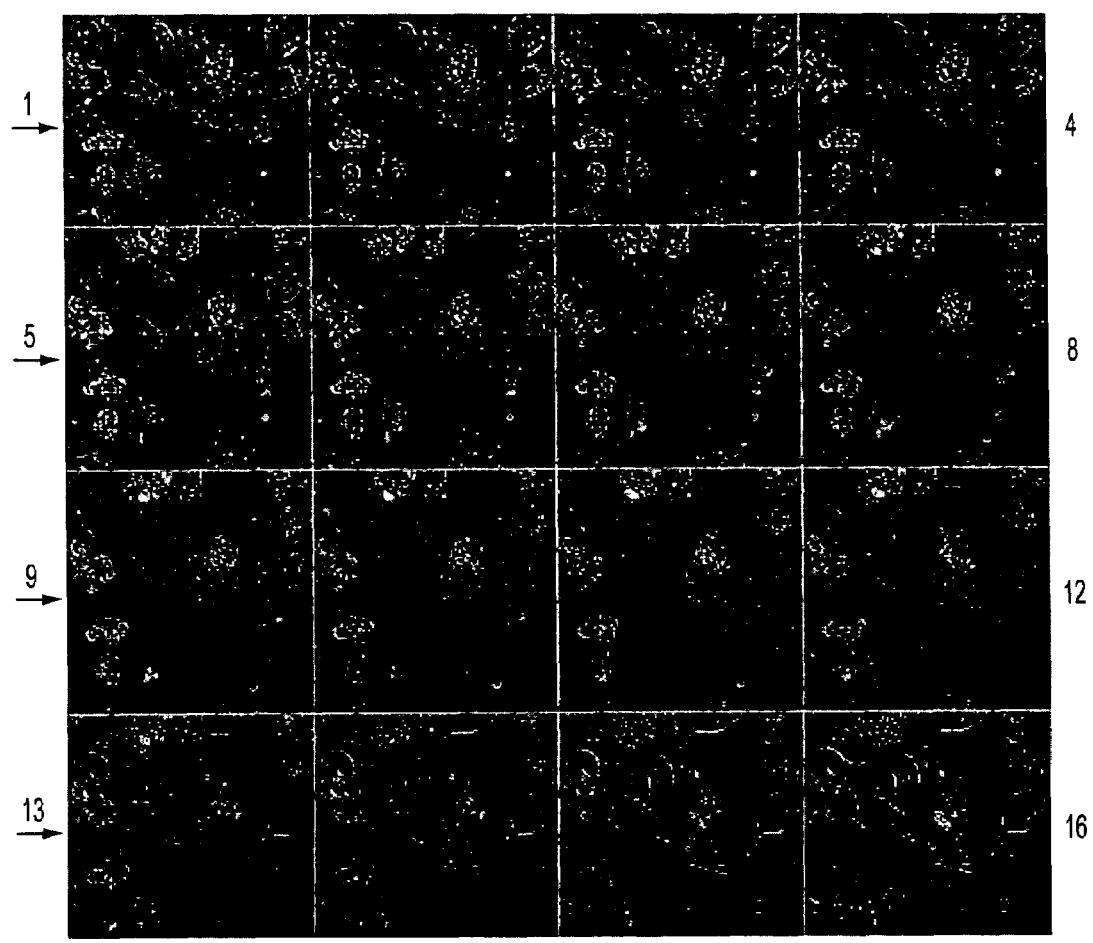
FIG. 6. Z-series imaging of corrected cells. Serial cross-sections of the HeLa cell represented in FIG. 5 are produced by Zeiss 510 LSM confocal microscope revealing that the fusion protein is contained within the cell.

FIG. 5A is a confocal picture of HeLa cells expressing the corrected fusion protein from an episomal target. Gene repair is accomplished by the action of a modified single-stranded oligonucleotide containing 3 phosphorothioate linkages at each end (3S/25G). FIG. 5B represents a "Z-series" of HeLa cells bearing the corrected fusion gene. This series sections the cells from bottom to top and illustrates that the fluorescent signal is "inside the cells".

Results. In summary, we have designed a novel class of single-stranded oligonucleotides with backbone modifications at the termini and demonstrate gene repair/conversion activity in mammalian and plant cell-free extracts. We confirm that the all DNA strand of the RNA-DNA double-stranded double hairpin chimera is the active component in the process of gene repair. In some cases, the relative frequency of repair by the novel oligonucleotides of the invention is elevated approximately 3-4-fold when compared to frequencies directed by chimeric RNA-DNA double hairpin oligonucleotides.

This strategy centers around the use of extracts from various sources to correct a mutation in a plasmid using a modified single-stranded or a chimeric RNA-DNA double hairpin oligonucleotide. A mutation is placed inside the coding region of a gene conferring antibiotic resistance in bacteria, here kanamycin or tetracycline. The appearance of resistance is measured by genetic readout in *E.coli* grown in the presence of the specified antibiotic. The importance of this system is that both phenotypic alteration and genetic inheritance can be measured. Plasmid pK$^s$m4021 contains a mutation (T→G) at residue 4021 rendering it unable to confer antibiotic resistance in *E.coli*. This point mutation is targeted for repair by oligonucleotides designed to restore kanamycin resistance. To avoid concerns of plasmid contamination skewing the colony counts, the directed correction is from G→C rather than G→T (wild-type). After isolation, the plasmid is electroporated into the DH10B strain of *E.coli*, which contains inactive RecA protein. The number of kanamycin colonies is counted and normalized by ascertaining the number of ampicillin colonies, a process that controls for the influence of electroporation. The number of colonies generated from three to five independent reactions was averaged and is presented for each experiment. A fold increase number is recorded to aid in comparison.

The original RNA-DNA double hairpin chimera design, e.g., as disclosed in U.S. Pat. No. 5,565,350, consists of two hybridized regions of a single-stranded oligonucleotide folded into a double hairpin configuration. The double-stranded targeting region is made up of a 5 base pair DNA/DNA segment bracketed by 10 base pair RNA/DNA segments. The central base pair is mismatched to the corresponding base pair in the target gene. When a molecule of this design is used to correct the kan$^s$ mutation, gene repair is observed (I in FIG. 1A). Chimera II (FIG. 1B) differs partly from chimera I in that only the DNA strand of the double hairpin is mismatched to the target sequence. When this chimera was used to correct the kan$^s$ mutation, it was twice as active. In the same study, repair function could be further increased by making the targeting region of the chimera a continuous RNA/DNA hybrid.

Frame shift mutations are repaired. By using plasmid pT$^s$Δ208, described in FIG. 1(C) and FIG. 3, the capacity of the modified single-stranded molecules that showed activity in correcting a point mutation, can be tested for repair of a frameshift. To determine efficiency of correction of the mutation, a chimeric oligonucleotide (Tet I), which is designed to insert a T residue at position 208, is used. A modified single-stranded oligonucleotide (Tet IX) directs the insertion of a T residue at this same site. FIG. 3 illustrates the plasmid and target bases designated for change in the experiments. When all reaction components are present (extract, plasmid, oligomer), tetracycline resistant colonies appear. The colony count increases with the amount of oligonucleotide used up to a point beyond which the count falls off (Table 3). No colonies above background are observed in the absence of either extract or oligonucleotide, nor when a modified single-stranded molecule bearing perfect complementarity is used. FIG. 3 represents the sequence surrounding the target site and shows that a T residue is inserted at the correct site. We have isolated plasmids from fifteen colonies obtained in three independent experiments and each analyzed sequence revealed the same precise nucleotide insertion. These data suggest that the single-stranded molecules used initially for point mutation correction can also repair nucleotide deletions.

Comparison of phosphorothioate oligonucleotides to 2'-O-methyl substituted oligonucleotides. From a comparison of molecules VII and XI, it is apparent that gene repair is more subject to inhibition by RNA residues than by phosphorothioate linkages. Thus, even though both of these oligonucleotides contain an equal number of modifications to impart nuclease resistance, XI (with 16 phosphorothioate linkages) has good gene repair activity while VII (with 16 2'-O-methyl RNA residues) is inactive. Hence, the original chimeric double hairpin oligonucleotide enabled correction directed, in large part, by the strand containing a large region of contiguous DNA residues.

Oligonucleotides can target multiple nucleotide alterations within the same template. The ability of individual single-stranded oligonucleotides to correct multiple mutations in a single target template is tested using the plasmid pK$^s$m4021 and the following single-stranded oligonucleotides modified with 3 phosphorothioate linkages at each end (indicated as underlined nucleotides): Oligo1 is a 25-mer with the sequence TTCGATAAGCCTATGCTGACCCGTG (SEQ ID NO:4377) corrects the original mutation present in the kanamycin resistance gene of pK$^s$m4021 as well as directing another alteration 2 basepairs away in the target sequence (both indicated in boldface); Oligo2 is a 70-mer with the 5'-end sequence TTCGGCTACGACTGGGCACAACAGACAATTGGC (SEQ ID NO:4378) with the remaining nucleotides being completely complementary to the kanamycin resistance gene and also ending in 3 phosphorothioate linkages at the 3' end. Oligo2 directs correction of the mutation in pK$^s$m4021 as well as directing another alteration 21 basepairs away in the target sequence (both indicated in boldface).

We also use additional oligonucleotides to assay the ability of individual oligonucleotides to correct multiple mutations in the pK$^s$M4021 plasmid. These include, for example, a second 25-mer that alters two nucleotides that are three nucleotides apart with the sequence 5'-TTGTGC-CCAGTCGTATCCGAATAGC-3' (SEQ ID NO:4379); a 70-mer that alters two nucleotides that are 21 nucleotides apart with the sequence 5'-CATCAGAGCAGCCAATTGTCTGTTGTGCCCAGTCGTAGCCGAATAGCCTCTCCACCCAAGCGGCCGGAGA-3' (SEQ ID NO:4380); and another 70-mer that alters two nucleotides that are 21 nucleotides apart with the sequence 5'-GCTGACAGCCGGAACACGGCGGCATCAGAGCAGCCAATTGTCTGTTGTGCCCAGTCGTAGCCGAATAGCCT-3' (SEQ ID NO:4381). The nucleotides in the oligonucleotides that direct alteration of the target sequence are underlined and in boldface. These oligonucleotides are modified in the same way as the other oligonucleotides of the invention.

We assay correction of the original mutation in pK$^s$m4021 by monitoring kanamycin resistance (the second alterations which are directed by Oligo2 and Oligo3 are silent with respect to the kanamycin resistance phenotype). In addition, in experiments with Oligo2, we also monitor cleavage of the resulting plasmids using the restriction enzyme Tsp509I which cuts at a specific site present only when the second alteration has occurred (at ATT in Oligo2). We then sequence these clones to determine whether the additional, silent alteration has also been introduced. The results of an analysis are presented below:

|  | Oligo1 (25-mer) | Oligo2 (70-mer) |
|---|---|---|
| Clones with both sites changed | 9 | 7 |
| Clones with a single site changed | 0 | 2 |
| Clones that were not changed | 4 | 1 |

Nuclease sensitivity of unmodified DNA oligonucleotide. Electrophoretic analysis of nucleic acid recovered from the cell-free extract reactions conducted here confirm that the unmodified single-stranded 25-mer did not survive incubation whereas greater than 90% of the terminally modified oligos did survive (as judged by photo-image analyses of agarose gels).

Plant extracts direct repair. The modified single-stranded constructs can be tested in plant cell extracts. We have observed gene alteration using extracts from multiple plant sources, including, for example, Arabidopsis, tobacco, banana, maize, soybean, canola, wheat, spinach as well as spinach chloroplast extract. We prepare the extracts by grinding plant tissue or cultured cells under liquid nitrogen with a mortar and pestle. We extract 3 ml of the ground plant tissue with 1.5 ml of extraction buffer (20 mM HEPES, pH7.5; 5 mM Kcl; 1.5 mM MgCl$_2$; 10 mM DTT; 10% [v/v] glycerol; and 1% [w/v] PVP). We then homogenize the samples with 15 strokes of a Dounce homogenizer. Following homogenization, we incubate the samples on ice for 1 hour and centrifuge at 3000×g for 5 minutes to remove plant cell debris. We then determine the protein concentration in the supernatants (extracts) by Bradford assay. We dispense 100 μg (protein) aliquots of the extracts which we freeze in a dry ice-ethanol bath and store at −80° C.

We describe experiments using two sources here: a dicot (canola) and a monocot (banana, *Musa acuminata* cv. Rasthali). Each vector directs gene repair of the kanamycin mutation (Table 4); however, the level of correction is elevated 2-3 fold relative to the frequency observed with the chimeric oligonucleotide. These results are similar to those observed in the mammalian system wherein a significant improvement in gene repair occurred when modified single-stranded molecules were used.

Tables are attached hereto.

TABLE I

Gene repair activity is directed by single-stranded oligonucleotides.

| Oligonucleotide | Plasmid | Extract (μg) | kan$^r$ colonies | Fold increase |
|---|---|---|---|---|
| I | pK$^s$m4021 | 10 | 300 | |
| I | ↓ | 20 | 418 | 1.0 × |
| II | ↓ | 10 | 537 | |
| II | ↓ | 20 | 748 | 1.78 × |
| III | ↓ | 10 | 3 | |
| III | ↓ | 20 | 5 | 0.01 × |
| IV | ↓ | 10 | 112 | |
| IV | ↓ | 20 | 96 | 0.22 × |
| V | ↓ | 10 | 217 | |
| V | ↓ | 20 | 342 | 0.81 × |
| VI | ↓ | 10 | 6 | |
| VI | ↓ | 20 | 39 | 0.093 × |
| VII | ↓ | 10 | 0 | |
| VII | ↓ | 20 | 0 | 0 × |
| VIII | ↓ | 10 | 3 | |
| VIII | ↓ | 20 | 5 | 0.01 × |
| IX | ↓ | 10 | 936 | |
| IX | ↓ | 20 | 1295 | 3.09 × |
| X | ↓ | 10 | 1140 | |
| X | ↓ | 20 | 1588 | 3.7 × |
| XI | ↓ | 10 | 480 | |
| XI | ↓ | 20 | 681 | 1.6 × |
| XII | ↓ | 10 | 18 | |
| XII | ↓ | 20 | 25 | 0.059 × |
| XIII | ↓ | 10 | 0 | |
| XIII | ↓ | 20 | 4 | 0.009 × |
| — | ↓ | 20 | 0 | |
| I | ↓ | — | 0 | |

Plasmid pK$^s$m4021 (1 μg), the indicated oligonucleotide (1.5 μg chimeric oligonucleotide or 0.55 μg single-stranded oligonucleotide; molar ratio of oligo to plasmid of 360 to 1) and either 10 or 20 μg of HUH7 cell-free extract were incubated 45 min at 37° C. Isolated plasmid DNA was electroporated into *E. coli* (strain DH10B) and the number of kan$^r$ colonies counted. The data represent the number of kanamycin resistant colonies per 10$^6$ ampicillin resistant colonies generated from the same reaction and is the average of three experiments (standard deviation usually less than +/−15%). Fold increase is defined relative to 418 kan$^r$ colonies (second reaction) and in all reactions was calculated using the 20 μg sample.

TABLE II

Modified single-stranded oligomers are not dependent on MSH2 or MSH3 for optimal gene repair activity.

| A. Oligonucleotide | Plasmid | Extract | kan$^r$ colonies |
|---|---|---|---|
| IX (3S/25G) | ↓ | HUH7 | 637 |
| X (6S/25G) | ↓ | HUH7 | 836 |
| IX | ↓ | MEF2$^{-/-}$ | 781 |
| X | ↓ | MEF2$^{-/-}$ | 676 |
| IX | ↓ | MEF3$^{-/-}$ | 582 |
| X | ↓ | MEF3$^{-/-}$ | 530 |
| IX | ↓ | MEF$^{+/+}$ | 332 |
| X | ↓ | MEF$^{+/+}$ | 497 |
| — | ↓ | MEF2$^{-/-}$ | 10 |
| — | ↓ | MEF3$^{-/-}$ | 5 |
| — | ↓ | MEF$^{+/+}$ | 14 |

Chimeric oligonucleotide (1.5 μg) or modified single-stranded oligonucleotide (0.55 μg) was incubated with 1 μg of plasmid pK$^s$m4021 and 20 μg of the indicated extracts. MEF represents mouse embryonic fibroblasts with either MSH2 (2$^{-/-}$) or MSH3 (3$^{-/-}$) deleted. MEF$^{+/+}$ indicates wild-type mouse embryonic fibroblasts. The other reaction components were then added and processed through the bacterial readout system. The data represent the number of kanamycin resistant colonies per $10^6$ ampicillin resistant colonies.

TABLE III

Frameshift mutation repair is directed by single-stranded oligonucleotides

| Oligonucleotide | Plasmid | Extract | tet[r] colonies |
|---|---|---|---|
| Tet IX (3S/25A; 0.5 μg) | pT[s]Δ208 (1 μg) | — | 0 |
| — | ↓ | 20 μg | 0 |
| Tet IX (0.5 μg) | ↓ | ↓ | 48 |
| Tet IX (1.5 μg) | ↓ | ↓ | 130 |
| Tet IX (2.0 μg) | ↓ | ↓ | 68 |
| Tet I (chimera; 1.5 μg) | ↓ | ↓ | 48 |

Each reaction mixture contained the indicated amounts of plasmid and oligonucleotide. The extract used for these experiments came from HUH7 cells. The data represent the number of tetracycline resistant colonies per $10^6$ ampicillin resistant colonies generated from the same reaction and is the average of 3 independent experiments. Tet I is a chimeric oligonucleotide and Tet IX is a modified single-stranded oligonucleotide that are designed to insert a T residue at position 208 of pT[s]Δ208. These oligonucleotides are equivalent to structures I and IX in FIG. 2.

TABLE IV

Plant cell-free extracts support gene repair by single-stranded oligonucleotides

| Oligonucleotide | Plasmid | Extract | kan[r] colonies |
|---|---|---|---|
| II (chimera) | pK[s]m4021 | 30 μg Canola | 337 |
| IX (3S/25G) | ↓ | Canola | 763 |
| X (6S/25G) | ↓ | Canola | 882 |
| II | ↓ | Musa | 203 |
| IX | ↓ | Musa | 343 |
| X | ↓ | Musa | 746 |
| — | ↓ | Canola | 0 |
| — | ↓ | Musa | 0 |
| IX | ↓ | — Canola | 0 |
| X | ↓ | — Musa | 0 |

Canola or Musa cell-free extracts were tested for gene repair activity on the kanamycin-sensitive gene as previously described in (18). Chimeric oligonucleotide II (1.5 μg) and modified single-stranded oligonucleotides IX and X (0.55 μg) were used to correct pK[s]m4021. Total number of kan[r] colonies are present per $10^7$ ampicillin resistant colonies and represent an average of four independent experiments.

TABLE V

Gene repair activity in cell-free extracts prepared from yeast (Saccharomyces cerevisiae)

| Cell-type | Plasmid | Chimeric Oligo | SS Oligo | kan[r]/amp[r] × $10^6$ |
|---|---|---|---|---|
| Wild type | pKan[s]m4021 | 1 μg | | 0.36 |
| Wild type | ↓ | | 1 μg | 0.81 |
| ΔRAD52 | ↓ | 1 μg | | 10.72 |
| ΔRAD52 | ↓ | | 1 μg | 17.41 |
| ΔPMS1 | ↓ | 1 μg | | 2.02 |
| ΔPMS1 | ↓ | | 1 μg | 3.23 |

In this experiment, the kan[s] gene in pKan[s]4021 is corrected by either a chimeric double-hairpin oligonucleotide or a single-stranded oligonucleotide containing three thioate linkages at each end (3S/25G).

EXAMPLE 2

Figures 7A, 7B, 7C:
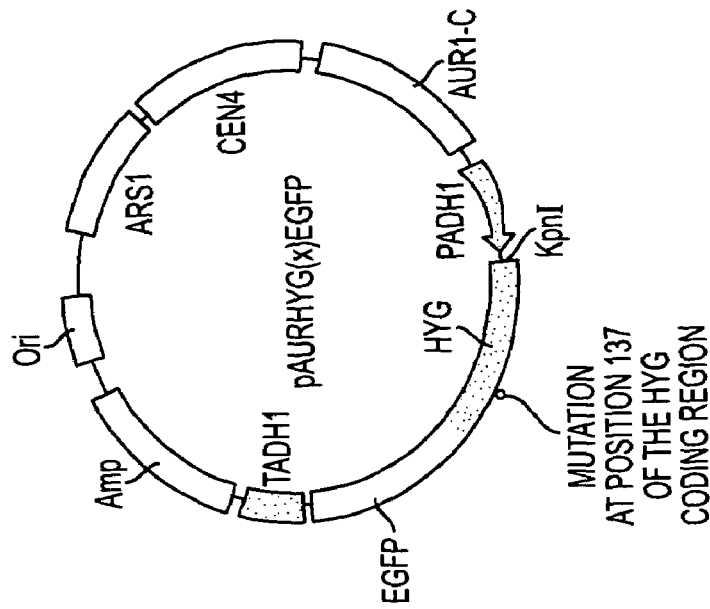
In FIG. 7A, the sequence of the normal allele corresponds to SEQ ID NO:4359, the sequence of the target/existing mutation corresponds to SEQ ID NO:4360 and the sequence of the desired alteration corresponds to SEQ ID NO:4361. (B) Plasmid pAURHYG(rep)GFP contains a base substitution mutation introducing a G at nucleotide 137, at codon 46, of the Hygromycin B coding sequence (cds). The target sequence presented below the diagram indicates the amino acid conservative replacement of G with C, restoring gene function.
In FIG. 7B, the sequence of the normal allele corresponds to SEQ ID NO:4359, the sequence of the target/existing mutation corresponds to SEQ ID NO:4362 and the sequence of the desired alteration corresponds to SEQ ID NO:4361.

Yeast Cell Targeting Assay Method for Base Alteration and Preferred Oligonucleotide Selection In this example, single-stranded oligonucleotides with modified backbones and double-hairpin oligonucleotides with chimeric, RNA-DNA backbones are used to measure gene repair using two episomal targets with a fusion between a hygromycin resistance gene and eGFP as a target for gene repair. These plasmids are pAURHYG(rep)GFP, which contains a point mutation in the hygromycin resistance gene (FIG. 7), pAURHYG(ins)GFP, which contains a single-base insertion in the hygromycin resistance gene (FIG. 7) and pAURHYG(Δ)GFP which has a single base deletion. We also use the plasmid containing a wild-type copy of the hygromycin-eGFP fusion gene, designated pAURHYG(wt) GFP, as a control. These plasmids also contain an aureobasidinA resistance gene. In pAURHYG(rep)GFP, hygromycin resistance gene function and green fluorescence from the eGFP protein are restored when a G at position 137, at codon 46 of the hygromycin B coding sequence, is converted to a C thus removing a premature stop codon in the hygromycin resistance gene coding region. In pAURHYG(ins)GFP, hygromycin resistance gene function and green fluorescence from the eGFP protein are restored when an A inserted between nucleotide positions 136 and 137, at codon 46 of the hygromycin B coding sequence, is deleted and a C is substituted for the T at position 137, thus correcting a frameshift mutation and restoring the reading frame of the hygromycin-eGFP fusion gene.

We synthesize the set of three yeast expression constructs pAURHYG(rep)eGFP, pAURHYG(Δ)eGFP, pAURHYG (ins)eGFP, that contain a point mutation at nucleotide 137 of the hygromycin-B coding sequence as follows. (rep) indicates a T137→G replacement, (Δ) represents a deletion of the G137 and (ins) represents an A insertion between nucleotides 136 and 137. We construct this set of plasmids by excising the respective expression cassettes by restriction digest from pHyg(x)EGFP and ligation into pAUR123 (Panvera, Calif.). We digest 10 μg pAUR123 vector DNA, as well as, 10 μg of each pHyg(x)EGFP construct with KpnI and SalI (NEB). We gel purify each of the DNA fragments and prepare them for enzymatic ligation. We ligate each mutated insert into pHygEGFP vector at 3:1 molar ration using T4 DNA ligase (Roche). We screen clones by restriction digest, confirm by Sanger dideoxy chain termination sequencing and purify using a Qiagen maxiprep kit.

Figure 8:
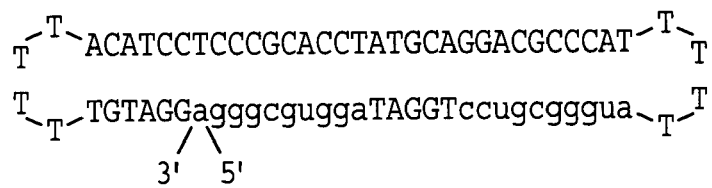
FIG. 8. Oligonucleotides for correction of hygromycin resistance gene. The sequence of the oligonucleotides used in experiments to assay correction of a hygromycin resistance gene are shown. DNA residues are shown in capital letters, RNA residues are shown in lowercase and nucleotides with a phosphorothioate backbone are capitalized and underlined.

We use this system to assay the ability of five oligonucleotides (shown in FIG. 8) to support correction under a variety of conditions. The oligonucleotides which direct correction of the mutation in pAURHYG(rep)GFP can also direct correction of the mutation in pAURHYG(ins)GFP. Three of the four oligonucleotides (HygE3T/25, HygE3T/74 and HygGG/Rev) share the same 25-base sequence surrounding the base targeted for alteration. HygGG/Rev is an RNA-DNA chimeric double hairpin oligonucleotide of the type described in the prior art. One of these oligonucleotides, HygE3T/74, is a 74-base oligonucleotide with the 25-base sequence centrally positioned. The fourth oligonucleotide, designated HygE3T/74α, is the reverse complement of HygE3T/74. The fifth oligonucleotide, designated Kan70T, is a non-specific, control oligonucleotide which is not complementary to the target sequence. Alternatively, an oligonucleotide of identical sequence but lacking a mismatch to the target or a completely thioate modified oligonucleotide or a completely 2-O-methylated modified oligonucleotide may be used as a control.

Oligonucleotide synthesis and cells. We synthesized and purified the chimeric, double-hairpin oligonucleotides and single-stranded oligonucleotides (including those with the indicated modifications) as described in Example 1. Plasmids used for assay were maintained stably in yeast (*Saccharomyces cerevisiae*) strain LSY678 MATα at low copy number under aureobasidin selection. Plasmids and oligonucleotides are introduced into yeast cells by electroporation as follows: to prepare electrocompetent yeast cells, we inoculate 10 ml of YPD media from a single colony and grow the cultures overnight with shaking at 300 rpm at 30° C. We then add 30 ml of fresh YPD media to the overnight cultures and continue shaking at 30° C. until the $OD_{600}$ was between 0.5 and 1.0 (3-5 hours). We then wash the cells by centrifuging at 4° C. at 3000 rpm for 5 minutes and twice resuspending the cells in 25 ml ice-cold distilled water. We then centrifuge at 4° C. at 3000 rpm for 5 minutes and resuspend in 1 ml ice-cold 1M sorbitol and then finally centrifuge the cells at 4° C. at 5000 rpm for 5 minutes and resuspend the cells in 120 μl 1M sorbitol. To transform electrocompetent cells with plasmids or oligonucleotides, we mix 40 μl of cells with 5 μg of nucleic acid, unless otherwise stated, and incubate on ice for 5 minutes. We then transfer the mixture to a 0.2 cm electroporation cuvette and electroporate with a BIO-RAD Gene Pulser apparatus at 1.5 kV, 25 μF, 200Ω for one five-second pulse. We then immediately resuspend the cells in 1 ml YPD supplemented with 1M sorbitol and incubate the cultures at 30° C. with shaking at 300 rpm for 6 hours. We then spread 200 μl of this culture on selective plates containing 300 μg/ml hygromycin and spread 200 μl of a $10^5$ dilution of this culture on selective plates containing 500 ng/ml aureobasidinA and/or and incubate at 30° C. for 3 days to allow individual yeast colonies to grow. We then count the colonies on the plates and calculate the gene conversion efficiency by determining the number of hygromycin resistance colonies per $10^5$ aureobasidinA resistant colonies.

Frameshift mutations are repaired in yeast cells. We test the ability of the oligonucleotides shown in FIG. 8 to correct a frameshift mutation in vivo using LSY678 yeast cells containing the plasmid pAURHYG(ins)GFP. These experiments, presented in Table 6, indicate that these oligonucleotides can support gene correction in yeast cells. These data reinforce the results described in Example 1 indicating that oligonucleotides comprising phosphorothioate linkages facilitate gene correction much more efficiently than control duplex, chimeric RNA-DNA oligonucleotides. This gene correction activity is also specific as transformation of cells with the control oligonucleotide Kan70T produced no hygromycin resistant colonies above background and thus Kan70T did not support gene correction in this system. In addition, we observe that the 74-base oligonucleotide (HygE3T/74) corrects the mutation in pAURHYG(ins)GFP approximately five-fold more efficiently than the 25-base oligonucleotide (HygE3T/25). We also perform control experiments with LSY678 yeast cells containing the plasmid pAURHYG(wt)GFP. With this strain we observed that even without added oligonucleotides, there are too many hygromycin resistant colonies to count.

We also use additional oligonucleotides to assay the ability of individual oligonucleotides to correct multiple mutations in the pAUIRHYG(x)eGFP plasmid. These include, for example, one that alters two basepairs that are 3 nucleotides apart is a 74-mer with the sequence 5'-CTCGTGCTTTCAGCTTCGATGTAGGAGGGCG-TGGGTA CGTCCTGCGGGTAAATAGCTGCGCCGATGGTTT-CTAC-3' (SEQ ID NO:4382); a 74-mer that alters two basepairs that are 15 nucleotides apart with the sequence 5'-CTCGTGCTTTCAGCTTCGATGTAG-GAGGGCGTGGATACGTCCTGCGGGTAAA CAGCTGCGCCGATGGTTTCTAC-3 (SEQ ID NO:4383)'; and a 74-mer that alters two basepairs that are 27 nucleotides apart with the sequence 5'-CTCGTGCTTTCAGCTTCGAT-GTAGGAGGGCGTGGATA CGTCCTGCGGGTAAATAGCTGCGCCGA CGGTTTCTAC (SEQ ID NO:4384). The nucleotides in these oligonucleotides that direct alteration of the target sequence are underlined and in boldface. These oligonucleotides are modified in the same ways as the other oligonucleotides of the invention.

Figure 10:
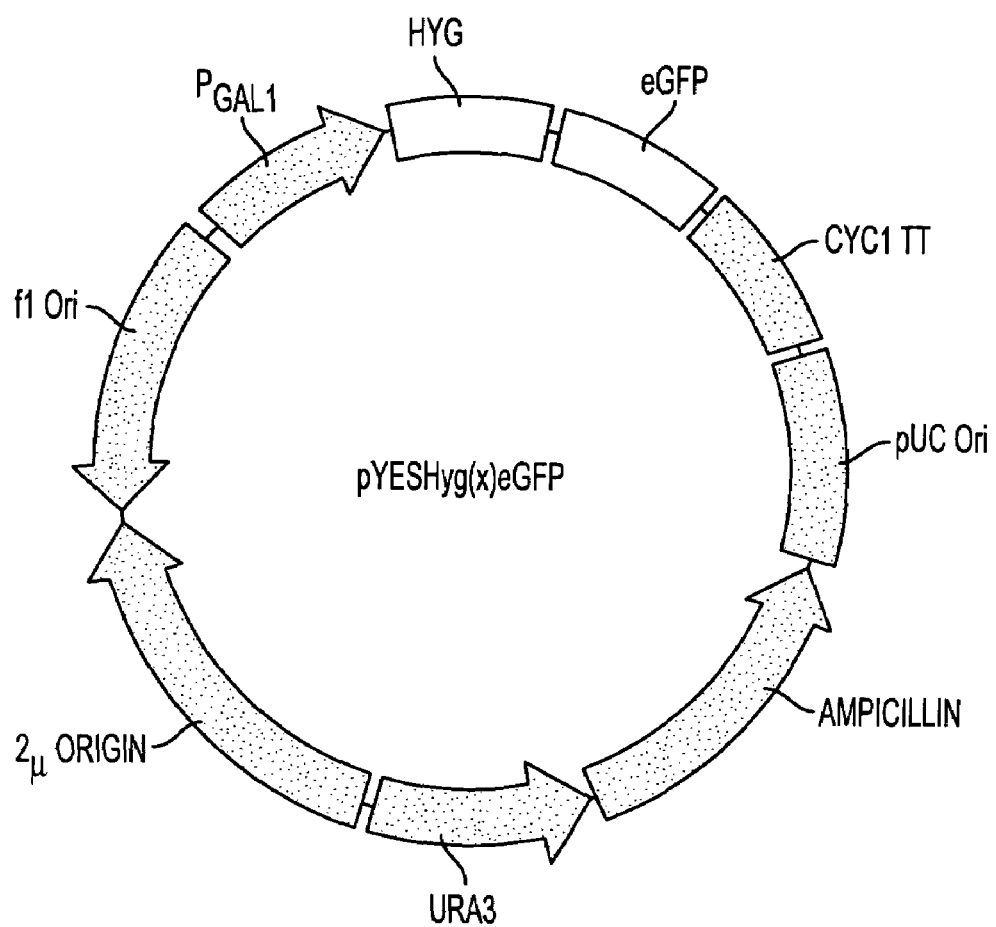
FIG. 10. pYESHyg(x)eGFP plasmid. This plasmid is a construct similar to the pAURHyg(x)eGFP construct shown in FIG. 7, except the promoter is the inducible GAL1 promoter. This promoter is inducible with galactose, leaky in the presence of raffinose, and repressed in the presence of dextrose.

Oligonucleotides targeting the sense strand direct gene coffection more efficiently. We compare the ability of single-stranded oligonucleotides to target each of the two strands of the target sequence of both pAURHYG(ins)GFP and pAURHYG(rep)GFP. These experiments, presented in Tables 7 and 8, indicate that an oligonucleotide, HygE3T/74α, with sequence complementary to the sense strand (i.e. the strand of the target sequence that is identical to the mRNA) of the target sequence facilitates gene correction approximately ten-fold more efficiently than an oligonucleotide, HygE3T/74, with sequence complementary to the non-transcribed strand which serves as the template for the synthesis of RNA. As indicated in Table 7, this effect was observed over a range of oligonucleotide concentrations from 0-3.6 μg, although we did observe some variability in the difference between the two oligonucleotides (indicated in Table 7 as a fold difference between HygE3T/74α and HygE3T/74). Furthermore, as shown in Table 8, we observe increased efficiency of correction by HygE3T/74α relative to HygE3T/74 regardless of whether the oligonucleotides were used to correct the base substitution mutation in pAURHYG(rep)GFP or the insertion mutation in pAURHYG(ins)GFP. The data presented in Table 8 further indicate that the single-stranded oligonucleotides correct a base substitution mutation more efficiently than an insertion mutation. However, this last effect was much less pronounced and the oligonucleotides of the invention are clearly able efficiently to correct both types of mutations in yeast cells. In addition, the role of transcription is investigated using plasmids with inducible promoters such as that described in FIG. 10.

Optimization of oligonucleotide concentration. To determine the optimal concentration of oligonucleotide for the purpose of gene alteration, we test the ability of increasing concentrations of Hyg3T/74α to correct the mutation in pAURHYG(rep)GFP contained in yeast LSY678. We chose this assay system because our previous experiments indicated that it supports the highest level of correction. However, this same approach could be used to determine the optimal concentration of any given oligonucleotide. We test the ability of Hyg3T/74α to correct the mutation in pAURHYG(rep)GFP contained in yeast LSY678 over a range of oligonucleotide concentrations from 0-10.0 μg. As shown in Table 9, we observe that the correction efficiency initially increases with increasing oligonucleotide concentration, but then declines at the highest concentration tested.

Tables are attached hereto.

TABLE 6

Correction of an insertion mutation in pAURHYG(ins)GFP by HygGG/Rev, HygE3T/25 and HygE3T/74

| Oligonucleotide Tested | Colonies on Hygromycin | Colonies on Aureobasidin (/10⁵) | Correction Efficiency |
|---|---|---|---|
| HygGG/Rev | 3 | 157 | 0.02 |
| HygE3T/25 | 64 | 147 | 0.44 |
| HygE3T/74 | 280 | 174 | 1.61 |
| Kan70T | 0 | — | — |

TABLE 7

An oligonucleotide targeting the sense strand of the target sequence corrects more efficiently.

| | Colonies per hygromycin plate | |
|---|---|---|
| Amount of Oligonucleotide (μg) | HygE3T/74 | HygE3T/74α |
| 0 | 0 | 0 |
| 0.6 | 24 | 128 (8.4x)* |
| 1.2 | 69 | 140 (7.5x)* |
| 2.4 | 62 | 167 (3.8x)* |
| 3.6 | 29 | 367 (15x)* |

*The numbers in parentheses represent the fold increase in efficiency for targeting the non-transcribed strand as compared to the other strand of a DNA duplex that encodes a protein.

TABLE 8

Correction of a base substitution mutation is more efficient than correction of a frame shift mutation.

| Oligonucleotide | Plasmid tested (contained in LSY678) | |
|---|---|---|
| Tested (5 μg) | pAURHYG(ins)GFP | pAURHYG(rep)GFP |
| HygE3T/74 | 72 | 277 |
| HygE3T/74α | 1464 | 2248 |
| Kan70T | 0 | 0 |

TABLE 9

Optimization of oligonucleotide concentration in electroporated yeast cells.

| Amount (μg) | Colonies on hygromycin | Colonies on aureobasidin (/10⁵) | Correction efficiency |
|---|---|---|---|
| 0 | 0 | 67 | 0 |
| 1.0 | 5 | 64 | 0.08 |
| 2.5 | 47 | 30 | 1.57 |
| 5.0 | 199 | 33 | 6.08 |
| 7.5 | 383 | 39 | 9.79 |
| 10.0 | 191 | 33 | 5.79 |

EXAMPLE 3

Cultured Cell Manipulation

Mononuclear cells are isolated from human umbilical cord blood of normal donors using Ficoll Hypaque (Pharmacia Biotech, Uppsala, Sweden) density centrifugation. CD34+ cells are immunomagnetically purified from mononuclear cells using either the progenitor or Multisort Kits (Miltenyi Biotec, Auburn, Calif.). Lin⁻CD38⁻ cells are purified from the mononuclear cells using negative selection with StemSep system according to the manufacturer's protocol (Stem Cell Technologies, Vancouver, Calif.). Cells used for microinjecton are either freshly isolated or cryopreserved and cultured in Stem Medium (S Medium) for 2 to 5 days prior to microinjecton. S Medium contains Iscoves' Modified Dulbecco's Medium without phenol red (IMDM) with 100 μg/ml glutamine/penicillin/streptomycin, 50 mg/ml bovine serum albumin, 50 μg/ml bovine pancreatic insulin, 1 mg/ml human transferrin, and IMDM; Stem Cell Technologies), 40 μg/ml low-density lipoprotein (LDL; Sigma, St. Louis, Mo.), 50 mM HEPEs buffer and 50 μM 2-mercaptoethanol, 20 ng/ml each of thrombopoietin, flt-3 ligand, stem cell factor and human IL-6 (Pepro Tech Inc., Rocky Hill, N.J.). After microinjection, cells are detached and transferred in bulk into wells of 48 well plates for culturing.

35 mm dishes are coated overnight at 40° C. with 50 μg/ml Fibronectn (FN) fragment CH-296 (Retronectn; TaKaRa Biomedicals, Panvera, Madison, Wis.) in phosphate buffered saline and washed with IMDM containing glutamine/penicillin/streptomycin. 300 to 2000 cells are added to cloning rings and attached to the plates for 45 minutes at 37° C. prior to microinjecton. After incubation, cloning rings are removed and 2 ml of S Medium are added to each dish for microinjecton. Pulled injection needles with a range of 0.22μ to 0.3μ outer tip diameter are used. Cells are visualized with a microscope equipped with a temperature controlled stage set at 37° C. and injected using an electronically interfaced Eppendorf Micromanipulator and Transjector. Successfully injected cells are intact, alive and remain attached to the plate post injection. Molecules that are flourescently labeled allow determination of the amount of oligonucleotide delivered to the cells.

For in vitro erythropoiesis from Lin⁻CD38⁻ cells, the procedure of Malik, 1998 can be used. Cells are cultured in ME Medium for 4 days and then cultured in E Medium for 3 weeks. Erythropoiesis is evident by glycophorin A expression as well as the presence of red color representing the presence of hemoglobin in the cultured cells. The injected cells are able to retain their proliferative capacity and the ability to generate myeloid and erythoid progeny. CD34+ cells can convert a normal A ($\beta^A$) to sickle T ($\beta^S$) mutation in the β-globin gene or can be altered using any of the oligonucleotides of the invention herein for correction or alteration of a normal gene to a mutant gene. Alternatively, stem cells can be isolated from blood of humans having genetic disease mutations and the oligonucleotides of the invention can be used to correct a defect or to modify genomes within those cells.

Alternatively, non-stem cell populations of cultured cells can be manipulated using any method known to those of skill in the art including, for example, the use of polycations, cationic lipids, liposomes, polyethylenimine (PEI), electroporaton, biolistcs, calcium phophate precipitation, or any other method known in the art.

Notes on the Tables Presented Below:

Each of the following tables presents, for the specified human gene, a plurality of mutations that are known to confer a clinically-relevant phenotype and, for each mutation, the oligonucleotides that can be used to correct the respective mutation site-specifically in the human genome according to the present invention.

The left-most column identifies each mutation and the clinical phenotype that the mutation confers.

For most entries, the mutation is identified at both the nucleic acid and protein level. At the amino acid level, mutations are presented according to the following standard nomenclature. The centered number identifies the position of the mutated codon in the protein sequence; to the left of the number is the wild type residue and to the right of the number is the mutant codon. Codon numbering is according to the Human Gene Mutation Database, Cardiff, Wales, UK. Terminator codons are shown as "TERM". At the nucleic acid level, the entire triplet of the wild type and mutated codons is shown.

The middle column presents, for each mutation, four oligonucleotides capable of repairing the mutation site-specifically in the human genome or in cloned human DNA including human DNA in artificial chromosomes, episomes, plasmids, or other types of vectors. The oligonucleotides of the invention, however, may include any of the oligonucleotides sharing portions of the sequence of the 121 base sequence. Thus, oligonucleotides of the invention for each of the depicted targets may be 18, 19, 20 up to about 121 nucleotides in length. Sequence may be added non-symmetrically.

All oligonucleotides are presented, per convention, in the 5' to 3' orientation. The nucleotide that effects the change in the genome is underlined and presented in bold.

The first of the four oligonucleotides for each mutation is a 121 nt oligonucleotide centered about the repair nucleotide. The second oligonucleotide, its reverse complement, targets the opposite strand of the DNA duplex for repair. The third oligonucleotide is the minimal 17 nt domain of the first oligonucleotide, also centered about the repair nucleotide. The fourth oligonucleotide is the reverse complement of the third, and thus represents the minimal 17 nt domain of the second.

The third column of each table presents the SEQ ID NO: of the respective repair oligonucleotide.

EXAMPLE 4

Adenosine Deaminase (ADA)

Adenosine deaminase (ADA, EC 3.5.4.4) catalyses the deamination of adenosine and 2'-deoxyadenosine to inosine or 2'-deoxyinosine respectively. ADA deficiency has been identified as the metabolic basis for 20-30% of cases with recessively inherited severe combined immunodeficiency (SCID). Affected infants are subject to recurrent chronic viral, fungal, protozoal, and bacterial infections and frequently present with persistent diarrhea, failure to thrive and candidiasis. In patients homozygous for ADA deficiency, 2'-deoxyadenosine accumulating during the rapid turnover of cells rich in DNA is converted back to dATP, either by adenosine kinase or deoxycytidine kinase. Many hypotheses have been advanced to explain the specific toxicity to the immune system in ADA deficiency. The apparently selective accumulation of dATP in thymocytes and peripheral blood B cells, with resultant inhibition of ribonucleotide reductase and DNA synthesis is probably the principal mechanism.

The structural gene for ADA is encoded as a single 32 kb locus containing 12 exons. Studies of the molecular defect in ADA-deficient patients have shown that mRNA is usually detectable in normal or supranormal amounts. Specific base substitution mutations have been detected in the majority of cases with the complete deficiency. A C-to-T base substitution mutation in exon 11 accounts for a high proportion of these, whilst a few patents are homozygous for large deletions encompassing exon I. A common point mutation resulting in a heat-labile ADA has been characterised in some patients with partial ADA deficiency, a disorder with an apparently increased prevalence in the Caribbean.

As yet no totally effective therapy for ADA deficiency has been reported, except in those few cases where bone marrow from an HLA/MLR compatible sibling donor was available.

Two therapeutic approaches have provided long-term benefit in specific instances. First, reconstitution using T cell depleted mismatched sibling marrow has been encouraging, particularly in early presenters completely deficient in ADA. Secondly, therapy with polyethylene glycol-modified adenosine deaminase (PEG-ADA) for more than 5 years has produced a sustained increase in lymphocyte numbers and mitogen responses together with evidence of in vivo B cell function. Success has generally been achieved in late presenters with residual ADA activity in mononuclear cells.

ADA deficiency has been chosen as the candidate disease for gene replacement therapy and the first human experiment commenced in 1990. The clinical consequences of overexpression of ADA activity—one of the potential hazards of gene implant—are known and take the form of an hereditary haemolytic anaemia associated with a tissue-specific increase in ADA activity. The genetic basis for the latter autosomal dominant disorder seemingly relates to markedly increased levels of structurally normal ADA mRNA.

TABLE 10

ADA Mutations and Genome-Correcting Oligos

| Clinical Phenotype & Mutation | Correcting Oligos | SEQ ID NO: |
|---|---|---|
| Adenosine deaminase deficiency GLN3TERM CAG to TAG | AGAGACCCACCGAGCGGCGGCGGAGGGAGCAGCGCCGGGG CGCACGAGGGCACCATGGCCCAGACGCCCGCCTTCGACAAG CCCAAAGTGAGCGCGCGCGGGGGCTCCGGGGACGGGGGTC | 1 |
| | GACCCCCGTCCCCGGAGCCCCCGCGCGCGCTCACTTTGGG CTTGTCGAAGGCGGGCGTCTGGGCCATGGTGCCCTCGTGCG CCCCGGCGCTGCTCCCTCCGCCGCCGCTCGGTGGGTCTCT | 2 |
| | CCATGGCCCAGACGCCC | 3 |
| | GGGCGTCTGGGCCATGG | 4 |
| Adenosine deaminase deficiency HIS15ASP CAT to GAT | TATTTGTTCTCTCTCTCCCTTTCTCTCTCTCTTCCCCCTGCCC CCTTGCAGGTAGAACTGCATGTCCACCTAGACGGATCCATCA AGCCTGAAACCATCTTATACTATGGCAGGTAAGTCC | 5 |

TABLE 10-continued

ADA Mutations and Genome-Correcting Oligos

| Clinical Phenotype & Mutation | Correcting Oligos | SEQ ID NO: |
|---|---|---|
| | GGACTTACCTGCCATAGTATAAGATGGTTTCAGGCTTGATGGA TCCGTCTAGGTGGACATGCAGTTCTACCTGCAAGGGGGCAG GGGGAAGAGAGAGAGAAAGGGAGAGAGAGAACAAATA | 6 |
| | TAGAACTGCATGTCCAC | 7 |
| | GTGGACATGCAGTTCTA | 8 |
| Adenosine deaminase deficiency GLY20ARG GGA to AGA | TCCCTTTCTCTCTCTCTTCCCCCTGCCCCCTTGCAGGTAGAA CTGCATGTCCACCTAGACGGATCCATCAAGCCTGAAACCATC TTATACTATGGCAGGTAAGTCCATACAGAAGAGCCCT | 9 |
| | AGGGCTCTTCTGTATGGACTTACCTGCCATAGTATAAGATGGT TTCAGGCTTGATGGATCCGTCTAGGTGGACATGCAGTTCTAC CTGCAAGGGGGCAGGGGGAAGAGAGAGAGAAAGGGA | 10 |
| | ACCTAGACGGATCCATC | 11 |
| | GATGGATCCGTCTAGGT | 12 |
| Adenosine deaminase deficiency GLY74CYS GGC to TGC | CCTGGAGCTCCCAAGGGACTTGGGGAAGGTTGTTCCCAACC CCTTTCTTCCCTTCCCAGGGGCTGCCGGGAGGCTATCAAAAG GATCGCCTATGAGTTTGTAGAGATGAAGGCCAAAGAGG | 13 |
| | CCTCTTTGGCCTTCATCTCTACAAACTCATAGGCGATCCTTTT GATAGCCTCCCGGCAGCCCCTGGGAAGGGAAGAAAGGGGTT GGGAACAACCTTCCCCAAGTCCCTTGGGAGCTCCAGG | 14 |
| | CTATCGCGGGCTGCCGG | 15 |
| | CCGGCAGCCCGCGATAG | 16 |
| Adenosine Deaminase Deficiency ARG76TRP CGG to TGG | GCTCCCAAGGGACTTGGGGAAGGTTGTTCCCAACCCCTTTCT TCCCTTCCCAGGGGCTGCCGGGAGGCTATCAAAAGGATCGC CTATGAGTTTGTAGAGATGAAGGCCAAAGAGGGCGTGG | 17 |
| | CCACGCCCTCTTTGGCCTTCATCTCTACAAACTCATAGGCGAT CCTTTTGATAGCCTCCCGGCAGCCCTGGGAAGGGAAGAAA GGGGTTGGGAACAACCTTCCCCAAGTCCCTTGGGAGC | 18 |
| | GGGGCTGCCGGGAGGCT | 19 |
| | AGCCTCCCGGCAGCCCC | 20 |
| Adenosine Deaminase Deficiency LYS80ARG AAA to AGA | TTGGGGAAGGTTGTTCCCAACCCCTTTCTTCCCTTCCCAGGG GCTGCCGGGAGGCTATCAAAAGGATCGCCTATGAGTTTGTAG AGATGAAGGCCAAAGAGGGCGTGGTGTATGTGGAGGT | 21 |
| | ACCTCCACATACACCACGCCCTCTTTGGCCTTCATCTCTACAA ACTCATAGGCGATCCTTTTGATAGCCTCCCGGCAGCCCCTGG GAAGGGAAGAAAGGGGTTGGGAACAACCTTCCCCAA | 22 |
| | GGCTATCAAAAGGATCG | 23 |
| | CGATCCTTTTGATAGCC | 24 |
| Adenosine deaminase deficiency ALA83ASP GCC to GAC | GTTGTTCCCAACCCCTTTCTTCCCTTCCCAGGGGCTGCCGGG AGGCTATCAAAAGGATCGCCTATGAGTTTGTAGAGATGAAGG CCAAAGAGGGCGTGGTGTATGTGGAGGTGCGGTACAG | 25 |
| | CTGTACCGCACCTCCACATACACCACGCCCTCTTTGGCCTTC ATCTCTACAAACTCATAGGCGATCCTTTTGATAGCCTCCCGGC AGCCCCTGGGAAGGGAAGAAAGGGGTTGGGAACAAC | 26 |
| | AAGGATCGCCTATGAGT | 27 |
| | ACTCATAGGCGATCCTT | 28 |
| Adenosine deaminase deficiency TYR97CYS TAT to TGT | AGGCTATCAAAAGGATCGCCTATGAGTTTGTAGAGATGAAGG CCAAAGAGGGCGTGGTGTATGTGGAGGTGCGGTACAGTCCG CACCTGCTGGCCAACTCCAAAGTGGAGCCAATCCCCTG | 29 |
| | CAGGGGATTGGCTCCACTTTGGAGTTGGCCAGCAGGTGCGG ACTGTACCGCACCTCCACATACACCACGCCCTCTTTGGCCTT | 30 |

TABLE 10-continued

ADA Mutations and Genome-Correcting Oligos

| Clinical Phenotype & Mutation | Correcting Oligos | SEQ ID NO: |
|---|---|---|
| | CATCTCTACAAACTCATAGGCGATCCTTTTGATAGCCT | |
| | CGTGGTGTATGTGGAGG | 31 |
| | CCTCCACATACACCACG | 32 |
| Adenosine deaminase deficiency ARG101GLN CGG to CAG | GGATCGCCTATGAGTTTGTAGAGATGAAGGCCAAAGAGGGCG TGGTGTATGTGGAGGTGCGGTACAGTCCGCACCTGCTGGCC AACTCCAAAGTGGAGCCAATCCCCTGGAACCAGGCTGA | 33 |
| | TCAGCCTGGTTCCAGGGGATTGGCTCCACTTTGGAGTTGGCC AGCAGGTGCGGACTGTACCGCACCTCCACATACACCACGCC CTCTTTGGCCTTCATCTCTACAAACTCATAGGCGATCC | 34 |
| | GGAGGTGCGGTACAGTC | 35 |
| | GACTGTACCGCACCTCC | 36 |
| Adenosine deaminase deficiency ARG101LEU CGG to CTG | GGATCGCCTATGAGTTTGTAGAGATGAAGGCCAAAGAGGGCG TGGTGTATGTGGAGGTGCGGTACAGTCCGCACCTGCTGGCC AACTCCAAAGTGGAGCCAATCCCCTGGAACCAGGCTGA | 37 |
| | TCAGCCTGGTTCCAGGGGATTGGCTCCACTTTGGAGTTGGCC AGCAGGTGCGGACTGTACCGCACCTCCACATACACCACGCC CTCTTTGGCCTTCATCTCTACAAACTCATAGGCGATCC | 38 |
| | GGAGGTGCGGTACAGTC | 39 |
| | GACTGTACCGCACCTCC | 40 |
| Adenosine deaminase deficiency ARG101TRP CGG to TGG | AGGATCGCCTATGAGTTTGTAGAGATGAAGGCCAAAGAGGGC GTGGTGTATGTGGAGGTGCGGTACAGTCCGCACCTGCTGGCC CAACTCCAAAGTGGAGCCAATCCCCTGGAACCAGGCTG | 41 |
| | CAGCCTGGTTCCAGGGGATTGGCTCCACTTTGGAGTTGGCCA GCAGGTGCGGACTGTACCGCACCTCCACATACACCACGCCC TCTTTGGCCTTCATCTCTACAAACTCATAGGCGATCCT | 42 |
| | TGGAGGTGCGGTACAGT | 43 |
| | ACTGTACCGCACCTCCA | 44 |
| Adenosine deaminase deficiency PRO104LEU CCG to CTG | ATGAGTTTGTAGAGATGAAGGCCAAAGAGGGCGTGGTGTATG TGGAGGTGCGGTACAGTCCGCACCTGCTGGCCAACTCCAAA GTGGAGCCAATCCCCTGGAACCAGGCTGAGTGAGTGAT | 45 |
| | ATCACTCACTCAGCCTGGTTCCAGGGGATTGGCTCCACTTTG GAGTTGGCCAGCAGGTGCGGACTGTACCGCACCTCCACATA CACCACGCCCTCTTTGGCCTTCATCTCTACAAACTCAT | 46 |
| | GTACAGTCCGCACCTGC | 47 |
| | GCAGGTGCGGACTGTAC | 48 |
| Adenosine deaminase deficiency LEU106VAL CTG to GTG | TTTGTAGAGATGAAGGCCAAAGAGGGCGTGGTGTATGTGGAG GTGCGGTACAGTCCGCACCTGCTGGCCAACTCCAAAGTGGA GCCAATCCCCTGGAACCAGGCTGAGTGAGTGATGGGCC | 49 |
| | GGCCCATCACTCACTCAGCCTGGTTCCAGGGGATTGGCTCCA CTTTGGAGTTGGCCAGCAGGTGCGGACTGTACCGCACCTCC ACATACACCACGCCCTCTTTGGCCTTCATCTCTACAAA | 50 |
| | GTCCGCACCTGCTGGCC | 51 |
| | GGCCAGCAGGTGCGGAC | 52 |
| Adenosine deaminase deficiency LEU107PRO CTG to CCG | TAGAGATGAAGGCCAAAGAGGGCGTGGTGTATGTGGAGGTG CGGTACAGTCCGCACCTGCTGGCCAACTCCAAAGTGGAGCC AATCCCCTGGAACCAGGCTGAGTGAGTGATGGGCCTGGA | 53 |
| | TCCAGGCCCATCACTCACTCAGCCTGGTTCCAGGGGATTGGC TCCACTTTGGAGTTGGCCAGCAGGTGCGGACTGTACCGCAC CTCCACATACACCACGCCCTCTTTGGCCTTCATCTCTA | 54 |

TABLE 10-continued

ADA Mutations and Genome-Correcting Oligos

| Clinical Phenotype & Mutation | Correcting Oligos | SEQ ID NO: |
|---|---|---|
| | GCACCTGCTGGCCAACT | 55 |
| | AGTTGGCCAGCAGGTGC | 56 |
| Adenosine deaminase deficiency PRO126GLN CCA to CAA | GCCTTCCTTTTGCCTCAGGCCCATCCCTACTCCTCTCCTCAC ACAGAGGGGACCTCACCCCAGACGAGGTGGTGGCCCTAGTG GGCCAGGGCCTGCAGGAGGGGGAGCGAGACTTCGGGGT | 57 |
| | ACCCCGAAGTCTCGCTCCCCCTCCTGCAGGCCCTGGCCCAC TAGGGCCACCACCTCGTCTGGGGTGAGGTCCCCTCTGTGTG AGGAGAGGAGTAGGGATGGGCCTGAGGCAAAAGGAAGGC | 58 |
| | CCTCACCCCAGACGAGG | 59 |
| | CCTCGTCTGGGGTGAGG | 60 |
| Adenosine deaminase deficiency TAL129MET GTG to ATG | TTTGCCTCAGGCCCATCCCTACTCCTCTCCTCACACAGAGGG GACCTCACCCCAGACGAGGTGGTGGCCCTAGTGGGCCAGGG CCTGCAGGAGGGGGAGCGAGACTTCGGGGTCAAGGCCC | 61 |
| | GGGCCTTGACCCCGAAGTCTCGCTCCCCCTCCTGCAGGCC TGGCCCACTAGGGCCACCACCTCGTCTGGGGTGAGGTCCCC TCTGTGTGAGGAGAGGAGTAGGGATGGGCCTGAGGCAAA | 62 |
| | CAGACGAGGTGGTGGCC | 63 |
| | GGCCACCACCTCGTCTG | 64 |
| Adenosine deaminase deficiency GLY140GLU GGG to GAG | ACAGAGGGGACCTCACCCCAGACGAGGTGGTGGCCCTAGTG GGCCAGGGCCTGCAGGAGGGGGAGCGAGACTTCGGGGTCA AGGCCCGGTCCATCCTGTGCTGCATGCGCCACCAGCCCAG | 65 |
| | CTGGGCTGGTGGCGCATGCAGCACAGGATGGACCGGGCCTT GACCCCGAAGTCTCGCTCCCCCTCCTGCAGGCCCTGGCCCA CTAGGGCCACCACCTCGTCTGGGGTGAGGTCCCCTCTGT | 66 |
| | GCAGGAGGGGGAGCGAG | 67 |
| | CTCGCTCCCCCTCCTGC | 68 |
| Adenosine deaminase deficiency ARG142GLN CGA to CAA | GGGACCTCACCCCAGACGAGGTGGTGGCCCTAGTGGGCCAG GGCCTGCAGGAGGGGGAGCGAGACTTCGGGGTCAAGGCCC GGTCCATCCTGTGCTGCATGCGCCACCAGCCCAGTGAGTA | 69 |
| | TACTCACTGGGCTGGTGGCGCATGCAGCACAGGATGGACCG GGCCTTGACCCCGAAGTCTCGCTCCCCCTCCTGCAGGCCCT GGCCCACTAGGGCCACCACCTCGTCTGGGGTGAGGTCCC | 70 |
| | GGGGGAGCGAGACTTCG | 71 |
| | CGAAGTCTCGCTCCCCC | 72 |
| Adenosine deaminase deficiency ARG142TERM CGA to TGA | GGGGACCTCACCCCAGACGAGGTGGTGGCCCTAGTGGGCCA GGGCCTGCAGGAGGGGGAGCGAGACTTCGGGGTCAAGGCC CGGTCCATCCTGTGCTGCATGCGCCACCAGCCCAGTGAGT | 73 |
| | ACTCACTGGGCTGGTGGCGCATGCAGCACAGGATGGACCGG GCCTTGACCCCGAAGTCTCGCTCCCCCTCCTGCAGGCCCTG GCCCACTAGGGCCACCACCTCGTCTGGGTGAGGTCCCC | 74 |
| | AGGGGGAGCCGAGACTTC | 75 |
| | GAAGTCTCGCTCCCCCT | 76 |
| Adenosine deaminase deficiency ARG149GLN CGG to CAG | TGGTGGCCCTAGTGGGCCAGGGCCTGCAGGAGGGGGAGCG AGACTTCGGGGTCAAGGCCCGGTCCATCCTGTGCTGCATGC GCCACCAGCCCAGTGAGTAGGATCACCGCCCTGCCCAGGG | 77 |
| | CCCTGGGCAGGGCGGTGATCCTACTCACTGGGCTGGTGGCG CATGCAGCACAGGATGGACCGGGCCTTGACCCCGAAGTCTC GCTCCCCCTCCTGCAGGCCCTGGCCCACTAGGGCCACCA | 78 |

TABLE 10-continued

ADA Mutations and Genome-Correcting Oligos

| Clinical Phenotype & Mutation | Correcting Oligos | SEQ ID NO: |
|---|---|---|
| | CAAGGCCCGGTCCATCC | 79 |
| | GGATGGACCGGGCCTTG | 80 |
| Adenosine deaminase deficiency ARG149TRP CGG to TGG | GTGGTGGCCCTAGTGGGCCAGGGCCTGCAGGAGGGGAGC GAGACTTCGGGGTCAAGGCCCGGTCCATCCTGTGCTGCATG CGCCACCAGCCCAGTGAGTAGGATCACCGCCCTGCCCAGG | 81 |
| | CCTGGGCAGGGCGGTGATCCTACTCACTGGGCTGGTGGCGC ATGCAGCACAGGATGGACCGGGCCTTGACCCCGAAGTCTCG CTCCCCCTCCTGCAGGCCCTGGCCCACTAGGGCCACCAC | 82 |
| | TCAAGGCCCGGTCCATC | 83 |
| | GATGGACCGGGCCTTGA | 84 |
| Adenosine deaminase deficiency LEU152MET CTG to ATG | CTAGTGGGCCAGGGCCTGCAGGAGGGGAGCGAGACTTCG GGGTCAAGGCCCGGTCCATCCTGTGCTGCATGCGCCACCAG CCCAGTGAGTAGGATCACCGCCCTGCCCAGGGCCGCCCGT | 85 |
| | ACGGGCGGCCCTGGGCAGGGCGGTGATCCTACTCACTGGG CTGGTGGCGCATGCAGCACAGGATGGACCGGGCCTTGACCC CGAAGTCTCGCTCCCCCTCCTGCAGGCCCTGGCCCACTAG | 86 |
| | GGTCCATCCTGTGCTGC | 87 |
| | GCAGCACAGGATGGACC | 88 |
| Adenosine deaminase deficiency ARG156CYS CGC to TGC | GGCCTGCAGGAGGGGAGCGAGACTTCGGGGTCAAGGCCC GGTCCATCCTGTGCTGCATGCGCCACCAGCCCAGTGAGTAG GATCACCGCCCTGCCCAGGGCCGCCCGTCTCACCCTGGCC | 89 |
| | GGCCAGGGTGAGACGGGCGGCCCTGGGCAGGGCGGTGATC CTACTCACTGGGCTGGTGGCGCATGCAGCACAGGATGGACC GGGCCTTGACCCCGAAGTCTCGCTCCCCCTCCTGCAGGCC | 90 |
| | GCTGCATGCGCCACCAG | 91 |
| | CTGGTGGCGCATGCAGC | 92 |
| Adenosine deaminase deficiency ARG156HIS CGC to CAC | GCCTGCAGGAGGGGAGCGAGACTTCGGGGTCAAGGCCCG GTCCATCCTGTGCTGCATGCGCCACCAGCCCAGTGAGTAGG ATCACCGCCCTGCCCAGGGCCGCCCGTCTCACCCTGGCCC | 93 |
| | GGGCCAGGGTGAGACGGGCGGCCCTGGGCAGGGCGGTGAT CCTACTCACTGGGCTGGTGGCGCATGCAGCACAGGATGGAC CGGGCCTTGACCCCGAAGTCTCGCTCCCCCTCCTGCAGGC | 94 |
| | CTGCATGCGCCACCAGC | 95 |
| | GCTGGTGGCGCATGCAG | 96 |
| Adenosine deaminase deficiency VAL177MET GTG to ATG | CTGCCCACAGACTGGTCCCCCAAGGTGGTGGAGCTGTGTAA GAAGTACCAGCAGCAGACCGTGGTAGCCATTGACCTGGCTG GAGATGAGACCATCCCAGGAAGCAGCCTCTTGCCTGGAC | 97 |
| | GTCCAGGCAAGAGGCTGCTTCCTGGGATGGTCTCATCTCCAG CCAGGTCAATGGCTACCACGGTCTGCTGCTGGTACTTCTTAC ACAGCTCCACCACCTTGGGGGACCAGTCTGTGGGCAG | 98 |
| | AGCAGACCGTGGTAGCC | 99 |
| | GGCTACCACGGTCTGCT | 100 |
| Adenosine deaminase deficiency ALA179ASP GCC to GAC | CAGACTGGTCCCCCAAGGTGGTGGAGCTGTGTAAGAAGTAC CAGCAGCAGACCGTGGTAGCCATTGACCTGGCTGGAGATGA GACCATCCCAGGAAGCAGCCTCTTGCCTGGACATGTCCA | 101 |
| | TGGACATGTCCAGGCAAGAGGCTGCTTCCTGGGATGGTCTCA TCTCCAGCCAGGTCAATGGCTACCACGGTCTGCTGCTGGTAC TTCTTACACAGCTCCACCACCTTGGGGGACCAGTCT | 102 |

TABLE 10-continued

ADA Mutations and Genome-Correcting Oligos

| Clinical Phenotype & Mutation | Correcting Oligos | SEQ ID NO: |
|---|---|---|
| | CGTGGTAGCCATTGACC | 103 |
| | GGTCAATGGCTACCACG | 104 |
| Adenosine deaminase deficiency GLN199PRO CAG to CCG | CCATTGACCTGGCTGGAGATGAGACCATCCCAGGAAGCAGC CTCTTGCCTGGACATGTCCAGGCCTACCAGGTGGGTCCTGT GAGAAGGAATGGAGAGGCTGGCCCTGGGTGAGCTTGTCT | 105 |
| | AGACAAGCTCACCCAGGGCCAGCCTCTCCATTCCTTCTCACA GGACCCACCTGGTAGGCCTGGACATGTCCAGGCAAGAGGCT GCTTCCTGGGATGGTCTCATCTCCAGCCAGGTCAATGG | 106 |
| | ACATGTCCAGGCCTACC | 107 |
| | GGTAGGCCTGGACATGT | 108 |
| Adenosine deaminase deficiency ARG211CYS CGT to TGT | GCTAGGGCACCCATGACCTGGCTCTCCCCCTTCCAGGAGGC TGTGAAGAGCGGCATTCACCGTACTGTCCACGCCGGGGAGG TGGGCTCGGCCGAAGTAGTAAAAGAGGTGAGGGCCTGGG | 109 |
| | CCCAGGCCCTCACCTCTTTTACTACTTCGGCCGAGCCCACCT CCCCGGCGTGGACAGTACGGTGAATGCCGCTCTTCACAGCC TCCTGGAAGGGGGAGAGCCAGGTCATGGGTGCCCTAGC | 110 |
| | GCATTCACCGTACTGTC | 111 |
| | GACAGTACGGTGAATGC | 112 |
| Adenosine deaminase deficiency ARG211HIS CGT to CAT | CTAGGGCACCCATGACCTGGCTCTCCCCCTTCCAGGAGGCT GTGAAGAGCGGCATTCACCGTACTGTCCACGCCGGGGAGGT GGGCTCGGCCGAAGTAGTAAAAGAGGTGAGGGCCTGGGC | 113 |
| | GCCCAGGCCCTCACCTCTTTTACTACTTCGGCCGAGCCCACC TCCCCGGCGTGGACAGTACGGTGAATGCCGCTCTTCACAGC CTCCTGGAAGGGGGAGAGCCAGGTCATGGGTGCCCTAG | 114 |
| | CATTCACCGTACTGTGC | 115 |
| | GGACAGTACGGTGAATG | 116 |
| Adenosine deaminase deficiency ALA215THR GCC to ACC | ATGACCTGGCTCTCCCCCTTCCAGGAGGCTGTGAAGAGCGG CATTCACCGTACTGTCCACGCCGGGGAGGTGGGCTCGGCCG AAGTAGTAAAAGAGGTGAGGGCCTGGGCTGGCCATGGGG | 117 |
| | CCCCATGGCCAGCGCAGGCCCTCACCTCTTTTACTACTTCGG CCGAGCCCACCTCCCCGGCGTGGACAGTACGGTGAATGCCG CTCTTCACAGCCTCCTGGAAGGGGGAGAGCCAGGTCAT | 118 |
| | CTGTCCACGCCGGGGAG | 119 |
| | CTCCCCGGCGTGGACAG | 120 |
| Adenosine deaminase deficiency GLY216ARG GGG to AGG | ACCTGGCTCTCCCCCTTCCAGGAGGCTGTGAAGAGCGGCAT TCACCGTACTGTCCACGCCGGGGAGGTGGGCTCGGCCGAAG TAGTAAAAGAGGTGAGGGCCTGGGCTGGCCATGGGGTCC | 121 |
| | GGACCCCATGGCCAGCCCAGGCCCTCACCTCTTTTACTACTT CGGCCGAGCCCACCTCCCCGGCGTGGACAGTACGGTGAATG CCGCTCTTCACAGCCTCCTGGAAGGGGGAGAGCCAGGT | 122 |
| | TCCACGCCGGGGAGGTG | 123 |
| | CACCTCCCCGGCGTGGA | 124 |
| Adenosine deaminase deficiency GLU217LYS GAG to AAG | TGGCTCTCCCCCTTCCAGGAGGCTGTGAAGAGCGGCATTCA CCGTACTGTCCACGCCGGGGAGGTGGGCTCGGCCGAAGTAG TAAAAGAGGTGAGGGCCTGGGCTGGCCATGGGTCCCTC | 125 |
| | GAGGGACCCCATGGCCAGCCCAGGCCCTCACCTCTTTTACTA CTTCGGCCGAGCCCACCTCCCCGGCGTGGACAGTACGGTGA ATGCCGCTCTTCACAGCCTCCTGGAAGGGGGAGAGCCA | 126 |

TABLE 10-continued

ADA Mutations and Genome-Correcting Oligos

| Clinical Phenotype & Mutation | Correcting Oligos | SEQ ID NO: |
|---|---|---|
| | ACGCCGGGGAGGTGGGC | 127 |
| | GCCCACCTCCCCGGCGT | 128 |
| Adenosine deaminase deficiency THR233ILE ACA to ATA | CTGCCTCCTCCCATACTTGGCTCTATTCTGCTTCTCTACAGGC TGTGGACATACTCAAGACAGAGCGGCTGGGACACGGCTACC ACACCCTGGAAGACCAGGCCCTTTATAACAGGCTGCG | 129 |
| | CGCAGCCTGTTATAAAGGGCCTGGTCTTCCAGGGTGTGGTAG CCGTGTCCCAGCCGCTCTGTCTTGAGTATGTCCACAGCCTGT AGAGAAGCAGAATAGAGCCAAGTATGGGAGGAGGCAG | 130 |
| | ACTCAAGACAGAGCGGC | 131 |
| | GCCGCTCTGTCTTGAGT | 132 |
| Adenosine deaminase deficiency ARG253PRO CGG to CCG | CAGAGCGGCTGGGACACGGCTACCACACCCTGGAAGACCAG GCCCTTTATAACAGGCTGCGGCAGGAAAACATGCACTTCGAG GTAAGCGGGCCAGGGAGTGGGGAGGAACCATCCCCGGC | 133 |
| | GCCGGGGATGGTTCCTCCCCACTCCCTGGCCCGCTTACCTC GAAGTGCATGTTTTCCTGCCGCAGCCTGTTATAAAGGGCCTG GTCTTCCAGGGTGTGGTAGCCGTGTCCCAGCCGCTCTG | 134 |
| | CAGGCTGCGGCAGGAAA | 135 |
| | TTTCCTGCCGCAGCCTG | 136 |
| Adenosine deaminase deficiency GLN254TERM CAG to TAG | GAGCGGCTGGGACACGGCTACCACACCCTGGAAGACCAGGC CCTTTATAACAGGCTGCGGCAGGAAAACATGCACTTCGAGGT AAGCGGGCCAGGGAGTGGGGAGGAACCATCCCCGGCTG | 137 |
| | CAGCCGGGGATGGTTCCTCCCCACTCCCTGGCCCGCTTACC TCGAAGTGCATGTTTTCCTGCCGCAGCCTGTTATAAAGGGCC TGGTCTTCCAGGGTGTGGTAGCCGTGTCCCAGCCGCTC | 138 |
| | GGCTGCGGCAGGAAAAC | 139 |
| | GTTTTCCTGCCGCAGCC | 140 |
| Adenosine deaminase deficiency PRO274LEU CCG to CTG | CCACACACCTGCTCTTCCAGATCTGCCCCTGGTCCAGCTACC TCACTGGTGCCTGGAAGCCGGACACGGAGCATGCAGTCATT CGGTGAGCTCTGTTCCCCTGGGCCTGTTCAATTTTGTT | 141 |
| | AACAAAATTGAACAGGCCCAGGGGAACAGAGCTCACCGAATG ACTGCATGCTCCGTGTCCGGCTTCCAGGCACCAGTGAGGTA GCTGGACCAGGGGCAGATCTGGAAGAGCAGGTGTGTGG | 142 |
| | CTGGAAGCCGGACACGG | 143 |
| | CCGTGTCCGGCTTCCAG | 144 |
| Adenosine deaminase deficiency SER291LEU TCG to TTG | GGAGGCTGATTCTCTCCTCCTCCCTCTTCTGCAGGCTCAAAA ATGACCAGGCTAACTACTCGCTCAACACAGATGACCCGCTCA TCTTCAAGTCCACCCTGGACACTGATTACCAGATGAC | 145 |
| | GTCATCTGGTAATCAGTGTCCAGGGTGGACTTGAAGATGAGC GGGTCATCTGTGTTGAGCGAGTAGTTAGCCTGGTCATTTTTGA GCCTGCAGAAGAGGGAGGAGGAGAGAATCAGCCTCC | 146 |
| | TAACTACTCGCTCAACA | 147 |
| | TGTTGAGCGAGTAGTTA | 148 |
| Adenosine deaminase deficiency PRO297GLN CCG to CAG | CCTCCCTCTTCTGCAGGCTCAAAAATGACCAGGCTAACTACT CGCTCAACACAGATGACCCGCTCATCTTCAAGTCCACCCTGG ACACTGATTACCAGATGACCAAACGGGACATGGGCTT | 149 |
| | AAGCCCATGTCCCGTTTGGTCATCTGGTAATCAGTGTCCAGG GTGGACTTGAAGATGAGCGGGTCATCTGTGTTGAGCGAGTAG TTAGCCTGGTCATTTTTGAGCCTGCAGAAGAGGGAGG | 150 |

TABLE 10-continued

ADA Mutations and Genome-Correcting Oligos

| Clinical Phenotype & Mutation | Correcting Oligos | SEQ ID NO: |
|---|---|---|
| | AGATGACCCGCTCATCT | 151 |
| | AGATGAGCGGGTCATCT | 152 |
| Adenosine deaminase deficiency LEU304ARG CTG to CGG | AAAATGACCAGGCTAACTACTCGCTCAACACAGATGACCCGC TCATCTTCAAGTCCACCCTGGACACTGATTACCAGATGACCAA ACGGGACATGGGCTTTACTGAAGAGGAGTTTAAAAG | 153 |
| | CTTTTAAACTCCTCTTCAGTAAAGCCCATGTCCCGTTTGGTCA TCTGGTAATCAGTGTCCAGGGTGGACTTGAAGATGAGCGGGT CATCTGTGTTGAGCGAGTAGTTAGCCTGGTCATTTT | 154 |
| | GTCCACCCTGGACACTG | 155 |
| | CAGTGTCCAGGGTGGAC | 156 |
| Adenosine deaminase deficiency ALA329TAL C-to-T at base 1081 | GCCTTCTTTGTTCTCTGGTTCCATGTTGTCTGCCATTCTGGCC TTTCCAGAACATCAATGCGGCCAAATCTAGTTTCCTCCCAGAA GATGAAAAGAGGGAGCTTCTCGACCTGCTCTATAA | 157 |
| | TTATAGAGCAGGTCGAGAAGCTCCCTCTTTTCATCTTCTGGGA GGAAACTAGATTTGGCCGCATTGATGTTCTGGAAAGGCCAGA ATGGCAGACAACATGGAACCAGAGAACAAAGAAGGC | 158 |
| | CATCAATGCGGCCAAAT | 159 |
| | ATTTGGCCGCATTGATG | 160 |

EXAMPLE 5

P53 Mutations

The p53 gene codes for a protein that acts as a transcription factor and serves as a key regulator of the cell cycle. Mutation in this gene is probably the most significant genetic change characterizing the transformation of cells from normalcy to malignancy.

Inactivation of p53 by mutation disrupts the cell cycle which, in turn, sets the stage for tumor formation. Mutations in the p53 gene are among the most commonly diagnosed genetic disorders, occuring in as many as 50% of cancer patients. For some types of cancer, most notably of the breast, lung and colon, p53 mutations are the predominant genetic alternations found thus far. These mutations are associated with genomic instability and thus an increased susceptibility to cancer. Some p53 lesions result in malignancies that are resistant to the most widely used therapeutic regimens and therefore demand more aggressive treatment.

That p53 is associated with different malignant tumors is illustrated in the Li-Fraumeni autosomal dominant hereditary disorder characterized by familial multiple tumors due to mutation in the p53 gene. Affected individuals can develop one or more tumors, including: brain (12%); soft-tissue sarcoma (12%); breast cancer (25%); adrenal tumors (1%); bone cancer (osteosarcoma) (6%); cancer of the lung, prostate, pancreas, and colon as well as lymphoma and melanoma can also occur.

Certain of the most frequently mutated codons are codons 175, 248 and 273, however a variety of oligonucleotides are described below in the atttached table.

TABLE 11 p53 Mutations and Genome-Correcting Oligos

| Clinical Phenotype & Mutation | Correcting Oligos | SEQ ID NO: |
|---|---|---|
| In 2 families with Li-Fraumeni syndrome, there was a C-to-T mutation at the first nucleotide of codon 248 which changed arginine to tryptophan. | GACTGTACCACCATCCACTACAACTACATGTGTAACAGTTCCT GCATGGGCGGCATGAACCGGAGGCCCATCCTCACCATCATC ACACTGGAAGACTCCAGGTCAGGAGCCACTTGCCACC | 161 |
| | GGTGGCAAGTGGCTCCTGACCTGGAGTCTTCCAGTGTGATGA TGGTGAGGATGGGCCTCCGGTTCATGCCGCCCATGCAGGAA CTGTTACACATGTAGTTGTAGTGGATGGTGGTACAGTC | 162 |
| | GCATGAACCGGAGGCCC | 163 |
| | GGGCCTCCGGTTCATGC | 164 |

TABLE 11-continued p53 Mutations and Genome-Correcting Oligos

| Clinical Phenotype & Mutation | Correcting Oligos | SEQ ID NO: |
|---|---|---|
| In a family with the Li-Fraumeni syndrome, a G-to-A mutation at the first nucleotide of codon 258 resulting in the substitution of lysine for glutamic acid. | TGTAACAGTTCCTGCATGGGCGGCATGAACCGGAGGCCCAT CCTCACCATCATCACACTGGAAGACTCCAGGTCAGGAGCCAC TTGCCACCCTGCACACTGGCCTGCTGTGCCCCAGCCTC | 165 |
| | GAGGCTGGGGCACAGCAGGCCAGTGTGCAGGGTGGCAAGT GGCTCCTGACCTGGAGTCTTCCAGTGTGATGATGGTGAGGAT GGGCCTCCGGTTCATGCCGCCCATGCAGGAACTGTTACA | 166 |
| | TCACACTGGAAGACTCC | 167 |
| | GGAGTCTTCCAGTGTGA | 168 |
| In a family with the Li-Fraumeni syndrome, a G-to-T mutation at the first nucleotide of codon 245 resulting in the substitution of cysteine for glycine. | GTTGGCTCTGACTGTACCACCATCCACTACAACTACATGTGTA ACAGTTCCTGCATGGGCGGCATGAACCGGAGGCCCATCCTC ACCATCATCACACTGGAAGACTCCAGGTCAGGAGCCA | 169 |
| A gly245-to-ser, GGC-to-AGC, mutation was found in a patient in whom osteosarcoma was diagnosed at the age of 18 years. | TGGCTCCTGACCTGGAGTCTTCCAGTGTGATGATGGTGAGGA TGGGCCTCCGGTTCATGCCGCCCATGCAGGAACTGTTACACA TGTAGTTGTAGTGGATGGTGGTACAGTCAGAGCCAAC | 170 |
| | GCATGGGCGGCATGAAC | 171 |
| | GTTCATGCCGCCCATGC | 172 |
| In a family with the Li-Fraumeni syndrome, a germline mutation at codon 252: a T-to-C change at the second position resulted in substitution of proline for leucine. | TCCACTACAACTACATGTGTAACAGTTCCTGCATGGGCGGCA TGAACCGGAGGCCCATCCTCACCATCATCACACTGGAAGACT CCAGGTCAGGAGCCACTTGCCACCCTGCACACTGGCC | 173 |
| | GGCCAGTGTGCAGGGTGGCAAGTGGCTCCTGACCTGGAGTC TTCCAGTGTGATGATGTGAGGATGGGCCTCCGGTTCATGCC GCCCATGCAGGAACTGTTACACATGTAGTTGTAGTGGA | 174 |
| | GCCCATCCTCACCATCA | 175 |
| | TGATGGTGAGGATGGGC | 176 |
| Researchers analyzed for mutations in p53 hepatocellular carcinomas from patents in Qidong, an area of high incidence in China, in which both hepatitis B virus and aflatoxin B1 are risk factors. Eight of 16 tumors had a point mutation at the third base position of codon 249. The G-to-T mutation at codon 249 led to a change from arginine to serine (AGG to AGT). | TACCACCATCCACTACAACTACATGTGTAACAGTTCCTGCATG GGCGGCATGAACCGGAGGCCCATCCTCACCATCATCACACT GGAAGACTCCAGGTCAGGAGCCACTTGCCACCCTGCA | 177 |
| | TGCAGGGTGGCAAGTGGCTCCTGACCTGGAGTCTTCCAGTG TGATGATGGTGAGGATGGGCCTCCGGTTCATGCCGCCCATG CAGGAACTGTTACACATGTAGTTGTAGTGGATGGTGGTA | 178 |
| | AACCGGAGGCCCATCCT | 179 |
| | AGGATGGGCCTCCGGTT | 180 |
| In cases of hepatocellular carcinoma in southern Africa, a G-to-T substitution in codon 157 resulting in a change from valine to phenylahanine. | CTGGCCAAGACCTGCCCTGTGCAGCTGTGGGTTGATTCCACA CCCCCGCCCGGCACCCGCGTCCGCGCCATGGCCATCTACAA GCAGTCACAGCACATGACGGAGGTTGTGAGGCGCTGCC | 181 |
| | GGCAGCGCCTCACAACCTCCGTCATGTGCTGTGACTGCTTGT AGATGGCCATGGCGCGGACGCGGGTGCCGGGCGGGGTGT GGAATCAACCCACAGCTGCACAGGGCAGGTCTTGGCCAG | 182 |
| | GCACCCGCGTCCGCGCC | 183 |
| | GGCGCGGACGCGGGTGC | 184 |

TABLE 11-continued p53 Mutations and Genome-Correcting Oligos

| Clinical Phenotype & Mutation | Correcting Oligos | SEQ ID NO: |
|---|---|---|
| In a family with Li-Fraumeni in which noncancerous skin fibroblasts from affected individuals showed an unusual radiation-resistant phenotype, a point mutation in codon 245 of the P53 gene. A change from GGC to GAC predicted substitution of aspartic acid for glycine. | TTGGCTCTGACTGTACCACCATCCACTACAACTACATGTGTAA CAGTTCCTGCATGGGCGGCATGAACCGGAGGCCCATCCTCA CCATCATCACACTGGAAGACTCCAGGTCAGGAGCCAC | 185 |
| | GTGGCTCCTGACCTGGAGTCTTCCAGTGTGATGATGGTGAGG ATGGGCCTCCGGTTCATGCCGCCCATGCAGGAACTGTTACAC ATGTAGTTGTAGTGGATGGTGGTACAGTCAGAGCCAA | 186 |
| | CATGGGCGGCATGAACC | 187 |
| | GGTTCATGCCGCCCATG | 188 |
| In 2 of 8 families with Li-Fraumeni syndrome, a mutation in codon 248: a CGG-to-CAG change resulting in substitution of glutamine for arginine. | ACTGTACCACCATCCACTACAACTACATGTGTAACAGTTCCTG CATGGGCGGCATGAACCGGAGGCCCATCCTCACCATCATCA CACTGGAAGACTCCAGGTCAGGAGCCACTTGCCACCC | 189 |
| | GGGTGGCAAGTGGCTCCTGACCTGGAGTCTTCCAGTGTGAT GATGGTGAGGATGGGCCTCCGGTTCATGCCGCCCATGCAGG AACTGTTACACATGTAGTTGTAGTGGATGGTGGTACAGT | 190 |
| | CATGAACCGGAGGCCCA | 191 |
| | TGGGCCTCCGGTTCATG | 192 |
| In 9 members of an extended family with Li-Fraumeni syndrome, a germline mutation at codon 133 (ATG-to-ACG), resulted in the substitution of threonine for methionine (M133T), and completely cosegregated with the cancer syndrome. | CCCTGACTTTCAACTCTGTCTCCTTCCTCTTCCTACAGTACTC CCCTGCCCTCAACAAGATGTTTTGCCAACTGGCCAAGACCTG CCCTGTGCAGCTGTGGGTTGATTCCACACCCCCGCC | 193 |
| | GGCGGGGGTGTGGAATCAACCCACAGCTGCACAGGGCAGGT CTTGGCCAGTTGGCAAAACATCTTGTTGAGGGCAGGGGAGTA CTGTAGGAAGAGGAAGGAGACAGAGTTGAAAGTCAGGG | 194 |
| | CAACAAGATGTTTTGCC | 195 |
| | GGCAAAACATCTTGTTG | 196 |
| In 1 pedigree consistent with the Li-Fraumeni syndrome, a germline G-to-T transversion at codon 272 (valine to leucine) was found. | TCTTGCTTCTCTTTTCCTATCCTGAGTAGTGGTAATCTACTGG GACGGAACAGCTTTGAGGTGCGTGTTTGTGCCTGTCCTGGGA GAGACCGGCGCACAGAGGAAGAGAATCTCCGCAAGA | 197 |
| | TCTTGCGGAGATTCTCTTCCTCTGTGCGCCGGTCTCTCCCAG GACAGGCACAAACACGCACCTCAAAGCTGTTCCGTCCCAGTA GATTACCACTACTCAGGATAGGAAAAGAGAAGCAAGA | 198 |
| | GCTTTGAGGTGCGTGTT | 199 |
| | AACACGCACCTCAAAGC | 200 |
| A ser241-to-phe mutation due to a TCC-to-TTC change was found in a patient with hepatoblastoma and multiple foci of osteosarcoma. | TTATCTCCTAGGTTGGCTCTGACTGTACCACCATCCACTACAA CTACATGTGTAACAGTTCCTGCATGGGCGGCATGAACCGGAG GCCCATCCTCACCATCATCACACTGGAAGACTCCAG | 201 |
| | CTGGAGTCTTCCAGTGTGATGATGGTGAGGATGGGCCTCCG GTTCATGCCGCCCATGCAGGAACTGTTACACATGTAGTTGTA GTGGATGGTGGTACAGTCAGAGCCAACCTAGGAGATAA | 202 |
| | TAACAGTTCCTGCATGG | 203 |
| | CCATGCAGGAACTGTTA | 204 |
| An AAG-to-TAG change of codon 120, resulting in conversion from lysine to a stop codon, was found in a patient with osteosarcoma and adenocarcinoma of | CAGAAAACCTACCAGGGCAGCTACGGTTTCCGTCTGGGCTTC TTGCATTCTGGGACAGCCAAGTCTGTGACTTGCACGGTCAGT TGCCCTGAGGGGCTGGCTTCCATGAGACTTCAATGCC | 205 |
| | GGCATTGAAGTCTCATGGAAGCCAGCCCCTCAGGGCAACTG ACCGTGCAAGTCACAGACTTGGCTGTCCCAGAATGCAAGAAG CCCAGACGGAAACCGTAGCTGCCCTGGTAGGTTTTCTG | 206 |

TABLE 11-continued p53 Mutations and Genome-Correcting Oligos

| Clinical Phenotype & Mutation | Correcting Oligos | SEQ ID NO: |
|---|---|---|
| the lung at age 18 and brain tumor (glioma) at the age of 27. | GGACAGCCAAGTCTGTG | 207 |
| | CACAGACTTGGCTGTCC | 208 |
| A CGG-to-TGG change at codon 282, resulting in the substitution of tryptophan for arginine, was found in a patient who developed osteosarcoma at the age of 10 years. | GGTAATCTACTGGGACGGAACAGCTTTGAGGTGCGTGTTTGT GCCTGTCCTGGGAGAGACCGGCGCACAGAGGAAGAGAATCT CCGCAAGAAAGGGGAGCCTCACCACGAGCTGCCCCCAG | 209 |
| | CTGGGGGCAGCTCGTGGTGAGGCTCCCCTTTCTTGCGGAGA TTCTCTTCCTCTGTGCGCCGGTCTCTCCCAGGACAGGCACAA ACACGCACCTCAAAGCTGTTCCGTCCCAGTAGATTACC | 210 |
| | GGAGAGACCGGCGCACA | 211 |
| | TGTGCGCCGGTCTCTCC | 212 |
| In 5 of 6 anaplastic carcinomas of the thyroid and in an anaplastic carcinoma thyroid cell line ARO, a CGT-to-CAT mutation converted arginine-273 to histidine. | GCTTCTCTTTTCCTATCCTGAGTAGTGGTAATCTACTGGGACG GAACAGCTTTGAGGTGCGTGTTTGTGCCTGTCCTGGGAGAGA CCGGCGCACAGAGGAAGAGAATCTCCGCAAGAAAGG | 213 |
| | CCTTTCTTGCGGAGATTCTCTTCCTCTGTGCGCCGGTCTCTC CCAGGACAGGCACAAACACGCACCTCAAAGCTGTTCCGTCCC AGTAGATTACCACTACTCAGGATAGGAAAAGAGAAGC | 214 |
| | TGAGGTGCGTGTTTGTG | 215 |
| | CACAAACACGCACCTCA | 216 |
| A germline GGA-to-GTA mutation resulting in a change of glycine-325 to valine was found in a patient who had non-Hodgkin lymphoma diagnosed at age 17 and colon carcinoma at age 26. | TCCTAGCACTGCCCAACAACACCAGCTCCTCTCCCCAGCCAA AGAAGAAACCACTGGATGGAGAATATTTCACCCTTCAGGTACT AAGTCTTGGGACCTCTTATCAAGTGGAAAGTTTCCA | 217 |
| | TGGAAACTTTCCACTTGATAAGAGGTCCCAAGACTTAGTACCT GAAGGGTGAAATATTCTCCATCCAGTGGTTTCTTCTTTGGCTG GGGAGAGGAGCTGGTGTTGTTGGGCAGTGCTAGGAA | 218 |
| | ACTGGATGGAGAATATT | 219 |
| | AATATTCTCCATCCAGT | 220 |
| CGC-CCC Arg-72 to Pro association with Lung cancer | AATGGTTCACTGAAGACCCAGGTCCAGATGAAGCTCCCAGAA TGCCAGAGGCTGCTCCCCGCGTGGCCCCTGCACCAGCAGCT CCTACACCGGCGGCCCCTGCACCAGCCCCCTCCTGGCC | 221 |
| | GGCCAGGAGGGGGCTGGTGCAGGGGCCGCCGGTGTAGGAG CTGCTGGTGCAGGGGCCACGCGGGGAGCAGCCTCTGGCATT CTGGGAGCTTCATCTGGACCTGGGTCTTCAGTGAACCATT | 222 |
| | TGCTCCCCGCGTGGCCC | 223 |
| | GGGCCACGCGGGGAGCA | 224 |
| CCG-CTG Pro-82 to Leu Breast cancer | AAGCTCCCAGAATGCCAGAGGCTGCTCCCCGCGTGGCCCCT GCACCAGCAGCTCCTACACCGGCGGCCCCTGCACCAGCCCC CTCCTGGCCCCTGTCATCTTCTGTCCCTTCCCAGAAAAC | 225 |
| | GTTTTCTGGGAAGGGACAGAAGATGACAGGGGCCAGGAGGG GGCTGGTGCAGGGGCCGCCGGTGTAGGAGCTGCTGGTGCA GGGGCCACGCGGGGAGCAGCCTCTGGCATTCTGGGAGCTT | 226 |
| | TCCTACACCGGCGGCCC | 227 |
| | GGGCCGCCGGTGTAGGA | 228 |
| cCAA-TAA Gln-136 to Term Li-Fraumeni syndrome | TTCAACTCTGTCTCCTTCCTCTTCCTACAGTACTCCCCTGCCC TCAACAAGATGTTTTGCCAACTGGCCAAGACCTGCCCTGTGC AGCTGTGGGTTGATTCCACACCCCCGCCCGGCACCC | 229 |
| | GGGTGCCGGGCGGGGTGTGGAATCAACCCACAGCTGCACA GGGCAGGTCTTGGCCAGTTGGCAAAACATCTTGTTGAGGGCA GGGGAGTACTGTAGGAAGAGGAAGGAGACAGAGTTGAA | 230 |
| | TGTTTTGCCAACTGGCC | 231 |
| | GGCCAGTTGGCAAAACA | 232 |

TABLE 11-continued p53 Mutations and Genome-Correcting Oligos

| Clinical Phenotype & Mutation | Correcting Oligos | SEQ ID NO: |
|---|---|---|
| TGC-TAC<br>Cys-141 to Tyr<br>Li-Fraumeni syndrome | TCCTCTTCCTACAGTACTCCCCTGCCCTCAACAAGATGTTTTG<br>CCAACTGGCCAAGACCTGCCCTGTGCAGCTGTGGGTTGATTC<br>CACACCCCGCCCGGCACCCGCGTCCGCGCCATGGC | 233 |
| | GCCATGGCGCGGACGCGGGTGCCGGGCGGGGGTGTGGAAT<br>CAACCCACAGCTGCACAGGGCAGGTCTTGGCCAGTTGGCAA<br>AACATCTTGTTGAGGGCAGGGGAGTACTGTAGGAAGAGGA | 234 |
| | CAAGACCTGCCCTGTGC | 235 |
| | GCACAGGGCAGGTCTTG | 236 |
| aCCC-TCC<br>Pro-151 to Ser<br>Li-Fraumeni syndrome | AACAAGATGTTTTGCCAACTGGCCAAGACCTGCCCTGTGCAG<br>CTGTGGGTTGATTCCACACCCCCGCCCGGCACCCGCGTCCG<br>CGCCATGGCCATCTACAAGCAGTCACAGCACATGACGG | 237 |
| | CCGTCATGTGCTGTGACTGCTTGTAGATGGCCATGGCGCGG<br>ACGCGGGTGCCGGGCGGGGGTGTGGAATCAACCCACAGCT<br>GCACAGGGCAGGTCTTGGCCAGTTGGCAAAACATCTTGTT | 238 |
| | ATTCCACACCCCCGCCC | 239 |
| | GGGCGGGGGTGTGGAAT | 240 |
| CCG-CTG<br>Pro-152 to Leu<br>Adrenocortical carcinoma | AGATGTTTTGCCAACTGGCCAAGACCTGCCCTGTGCAGCTGT<br>GGGTTGATTCCACACCCCCGCCCGGCACCCGCGTCCGCGCC<br>ATGGCCATCTACAAGCAGTCACAGCACATGACGGAGGT | 241 |
| | ACCTCCGTCATGTGCTGTGACTGCTTGTAGATGGCCATGGCG<br>CGGACGCGGGTGCCGGGCGGGGGTGTGGAATCAACCCACA<br>GCTGCACAGGGCAGGTCTTGGCCAGTTGGCAAAACATCT | 242 |
| | CACACCCCCGCCCGGCA | 243 |
| | TGCCGGGCGGGGGTGTG | 244 |
| GGC-GTC<br>Gly-154 to Val<br>Glioblastoma | TTTGCCAACTGGCCAAGACCTGCCCTGTGCAGCTGTGGGTTG<br>ATTCCACACCCCCGCCCGGCACCCGCGTCCGCGCCATGGCC<br>ATCTACAAGCAGTCACAGCACATGACGGAGGTTGTGAG | 245 |
| | CTCACAACCTCCGTCATGTGCTGTGACTGCTTGTAGATGGCC<br>ATGGCGCGGACGCGGGTGCCGGGCGGGGTGTGGAATCAA<br>CCCACAGCTGCACAGGGCAGGTCTTGGCCAGTTGGCAAA | 246 |
| | CCCGCCCGGCACCCGCG | 247 |
| | CGCGGGTGCCGGGCGGG | 248 |
| CGC-CAC<br>Arg-175 to His<br>Li-Fraumeni syndrome | CCCGCGTCCGCGCCATGGCCATCTACAAGCAGTCACAGCAC<br>ATGACGGAGGTTGTGAGGCGCTGCCCCCACCATGAGCGCTG<br>CTCAGATAGCGATGGTGAGCAGCTGGGGCTGGAGAGACG | 249 |
| | CGTCTCTCCAGCCCCAGCTGCTCACCATCGCTATCTGAGCAG<br>CGCTCATGGTGGGGGCAGCGCCTCACAACCTCCGTCATGTG<br>CTGTGACTGCTTGTAGATGGCCATGGCGCGGACGCGGG | 250 |
| | TGTGAGGCGCTGCCCCC | 251 |
| | GGGGGCAGCGCCTCACA | 252 |
| tGAG-AAG<br>GTu-180 to Lys<br>Li-Fraumeni syndrome | ATGGCCATCTACAAGCAGTCACAGCACATGACGGAGGTTGTG<br>AGGCGCTGCCCCCACCATGAGCGCTGCTCAGATAGCGATGG<br>TGAGCAGCTGGGGCTGGAGAGACGACAGGGCTGGTTGC | 253 |
| | GCAACCAGCCCTGTCGTCTCTCCAGCCCCAGCTGCTCACCAT<br>CGCTATCTGAGCAGCGCTCATGGTGGGGGCAGCGCCTCACA<br>ACCTCCGTCATGTGCTGTGACTGCTTGTAGATGGCCAT | 254 |
| | CCCACCATGAGCGCTGC | 255 |
| | GCAGCGCTCATGGTGGG | 256 |

TABLE 11-continued p53 Mutations and Genome-Correcting Oligos

| Clinical Phenotype & Mutation | Correcting Oligos | SEQ ID NO: |
|---|---|---|
| gCGC-TGC<br>Arg-181 to Cys<br>Breast cancer | GCCATCTACAAGCAGTCACAGCACATGACGGAGGTTGTGAGG<br>CGCTGCCCCCACCATGAGCGCTGCTCAGATAGCGATGGTGA<br>GCAGCTGGGGCTGGAGAGACGACAGGGCTGGTTGCCCA | 257 |
| | TGGGCAACCAGCCCTGTCGTCTCTCCAGCCCCAGCTGCTCA<br>CCATCGCTATCTGAGCAGCGCTCATGGTGGGGGCAGCGCCT<br>CACAACCTCCGTCATGTGCTGTGACTGCTTGTAGATGGC | 258 |
| | ACCATGAGCGCTGCTCA | 259 |
| | TGAGCAGCGCTCATGGT | 260 |
| CGC-CAC<br>Arg-81 to His<br>Breast cancer | CCATCTACAAGCAGTCACAGCACATGACGGAGGTTGTGAGGC<br>GCTGCCCCCACCATGAGCGCTGCTCAGATAGCGATGGTGAG<br>CAGCTGGGGCTGGAGAGACGACAGGGCTGGTTGCCCAG | 261 |
| | CTGGGCAACCAGCCCTGTCGTCTCTCCAGCCCCAGCTGCTC<br>ACCATCGCTATCTGAGCAGCGCTCATGGTGGGGCAGCGCC<br>TCACAACCTCCGTCATGTGCTGTGACTGCTTGTAGATGG | 262 |
| | CCATGAGCGCTGCTCAG | 263 |
| | CTGAGCAGCGCTCATGG | 264 |
| CAT-CGT<br>His-193 to Arg<br>Li-Fraumeni syndrome | CCAGGGTCCCCAGGCCTCTGATTCCTCACTGATTGCTCTTAG<br>GTCTGGCCCCTCCTCAGCATCTTATCCGAGTGGAAGGAAATT<br>TGCGTGTGGAGTATTTGGATGACAGAAACACTTTTCG | 265 |
| | CGAAAAGTGTTTCTGTCATCCAAATACTCCACACGCAAATTTC<br>CTTCCACTCGGATAAGATGCTGAGGAGGGGCCAGACCTAAGA<br>GCAATCAGTGAGGAATCAGAGGCCTGGGGACCCTGG | 266 |
| | TCCTCAGCATCTTATCC | 267 |
| | GGATAAGATGCTGAGGA | 268 |
| cCGA-TGA<br>Arg-196 to Term<br>Adrenocortical carcinoma | CCCAGGCCTCTGATTCCTCACTGATTGCTCTTAGGTCTGGCC<br>CCTCCTCAGCATCTTATCCGAGTGGAAGGAAATTTGCGTGTG<br>GAGTATTTGGATGACAGAAACACTTTTCGACATAGTG | 269 |
| | CACTATGTCGAAAAGTGTTTCTGTCATCCAAATACTCCACACG<br>CAAATTTCCTTCCACTCGGATAAGATGCTGAGGAGGGGCCAG<br>ACCTAAGAGCAATCAGTGAGGAATCAGAGGCCTGGG | 270 |
| | ATCTTATCCGAGTGGAA | 271 |
| | TTCCACTCGGATAAGAT | 272 |
| cAGA-TGA<br>Arg-209 to Term<br>Li-Fraumeni syndrome | GCCCCTCCTCAGCATCTTATCCGAGTGGAAGGAAATTTGCGT<br>GTGGAGTATTTGGATGACAGAAACACTTTTCGACATAGTGTG<br>GTGGTGCCCTATGAGCCGCCTGAGGTCTGGTTTGCAA | 273 |
| | TTGCAAACCAGACCTCAGGCGGCTCATAGGGCACCACCACA<br>CTATGTCGAAAAGTGTTTCTTGTCATCCAAATACTCCACACGCA<br>AATTTCCTTCCACTCGGATAAGATGCTGAGGAGGGGC | 274 |
| | TGGATGACAGAAACACT | 275 |
| | AGTGTTTCTTGTCATCCA | 276 |
| tCGA-TGA<br>Arg-213 to Term<br>Li-Fraumeni syndrome | CATCTTATCCGAGTGGAAGGAAATTTGCGTGTGGAGTATTTG<br>GATGACAGAAACACTTTTCGACATAGTGTGGTGGTGCCCTAT<br>GAGCCGCCTGAGGTCTGGTTTGCAACTGGGGTCTCTG | 277 |
| | CAGAGACCCCAGTTGCAAACCAGACCTCAGGCGGCTCATAG<br>GCACCACCACACTATGTCGAAAAGTGTTTCTGTCATCCAAAT<br>ACTCCACACGCAAATTTCCTTCCACTCGGATAAGATG | 278 |
| | ACACTTTTCGACATAGT | 279 |
| | ACTATGTCGAAAAGTGT | 280 |
| gCCC-TCC | GGAAATTTGCGTGTGGAGTATTTGGATGACAGAAACACTTTTC | 281 |

TABLE 11-continued p53 Mutations and Genome-Correcting Oligos

| Clinical Phenotype & Mutation | Correcting Oligos | SEQ ID NO: |
|---|---|---|
| Pro-219 to Ser Adrenocortical carcinoma | GACATAGTGTGGTGGTGCCCTATGAGCCGCCTGAGGTCTGG TTTGCAACTGGGGTCTCTGGGAGGAGGGGTTAAGGGT | |
| | ACCCTTAACCCCTCCTCCCAGAGACCCCAGTTGCAAACCAGA CCTCAGGCGGCTCATAGGGCACCACCACACTATGTCGAAAAG TGTTTCTGTCATCCAAATACTCCACACGCAAATTTCC | 282 |
| | TGGTGGTGCCCTATGAG | 283 |
| | CTCATAGGGCACCACCA | 284 |
| TAT-TGT Tyr-220 to Cys Li-Fraumeni syndrome | ATTTGCGTGTGGAGTATTTGGATGACAGAAACACTTTTCGACA TAGTGTGGTGGTGCCCTATGAGCCGCCTGAGGTCTGGTTTG CAACTGGGGTCTCTGGGAGGAGGGGTTAAGGGTGGTT | 285 |
| | AACCACCCTTAACCCCTCCTCCCAGAGACCCCAGTTGCAAAC CAGACCTCAGGCGGCTCATAGGGCACCACCACACTATGTCG AAAAGTGTTTCTGTCATCCAAATACTCCACACGCAAAT | 286 |
| | GGTGCCCTATGAGCCGC | 287 |
| | GCGGCTCATAGGGCACC | 288 |
| cTCT-ACT Ser-227 to Thr Rhabdomyosarcoma | CACAGGTCTCCCCAAGGCGCACTGGCCTCATCTTTGGGCCTG TGTTATCTCCTAGGTTGGCTCTGACTGTACCACCATCCACTAC AACTACATGTGTAACAGTTCCTGCATGGGCGGCATGA | 289 |
| | TCATGCCGCCCATGCAGGAACTGTTACACATGTAGTTGTAGT GGATGGTGGTACAGTCAGAGCCAACCTAGGAGATAACACAG GCCCAAGATGAGGCCAGTGCGCCTTGGGGAGACCTGTG | 290 |
| | AGGTTGGCTCTGACTGT | 291 |
| | ACAGTCAGAGCCAACCT | 292 |
| cCAC-AAC His-233 to Asn Glioma | GCACTGGCCTCATCTTGGGCCTGTGTTATCTCCTAGGTTGGC TCTGACTGTACCACCATCCACTACAACTACATGTGTAACAGTT CCTGCATGGGCGGCATGAACCGGAGGCCCATCCTCA | 293 |
| | TGAGGATGGGCCTCCGGTTCATGCCGCCCATGCAGGAACTG TTACACATGTAGTTGTAGTGGATGGTGGTACAGTCAGAGCCA ACCTAGGAGATAACACAGGCCCAAGATGAGGCCAGTGC | 294 |
| | CCACCATCCACTACAAC | 295 |
| | GTTGTAGTGGATGGTGG | 296 |
| cAAC-GAC Asn-235 to Asp Adrenocortical carcinoma | GCCTCATCTTGGGCCTGTGTTATCTCCTAGGTTGGCTCTGAC TGTACCACCATCCACTACAACTACATGTGTAACAGTTCCTGCA TGGGCGGCATGAACCGGAGGCCCATCCTCACCATCA | 297 |
| | TGATGGTGAGGATGGGCCTCCGGTTCATGCCGCCCATGCAG GAACTGTTACACATGTAGTTGTAGTGGATGGTGGTACAGTCA GAGCCAACCTAGGAGATAACACAGGCCCAAGATGAGGC | 298 |
| | TCCACTACAACTACATG | 299 |
| | CATGTAGTTGTAGTGGA | 300 |
| AAC-AGC Asn-235 to Ser Rhabdomyosarcoma | CCTCATCTTGGGCCTGTGTTATCTCCTAGGTTGGCTCTGACT GTACCACCATCCACTACAACTACATGTGTAACAGTTCCTGCAT GGGCGGCATGAACCGGAGGCCCATCCTCACCATCAT | 301 |
| | ATGATGGTGAGGATGGGCCTCCGGTTCATGCCGCCCATGCA GGAACTGTTACACATGTAGTTGTAGTGGATGGTGGTACAGTC AGAGCCAACCTAGGAGATAACACAGGCCCAAGATGAGG | 302 |
| | CCACTACAACTACATGT | 303 |
| | ACATGTAGTTGTAGTGG | 304 |
| ATCc-ATG Ile-251 to Met Glioma | CATCCACTACAACTACATGTGTAACAGTTCCTGCATGGGCGG CATGAACCGGAGGCCCATCCTCACCATCATCACACTGGAAGA CTCCAGGTCAGGAGCCACTTGCCACCCTGCACACTGG | 305 |

TABLE 11-continued p53 Mutations and Genome-Correcting Oligos

| Clinical Phenotype & Mutation | Correcting Oligos | SEQ ID NO: |
|---|---|---|
| | CCAGTGTGCAGGGTGGCAAGTGGCTCCTGACGTGGAGTCTT CCAGTGTGATGATGGTGAGGATGGGCCTCCGGTTCATGCCG CCCATGCAGGAACTGTTACACATGTAGTTGTAGTGGATG | 306 |
| | AGGCCCATCCTCACCAT | 307 |
| | ATGGTGAGGATGGGCCT | 308 |
| ACA-ATA Thr-256 to Ile Glioblastoma | ACATGTGTAACAGTTCCTGCATGGGCGGCATGAACCGGAGG CCCATCCTCACCATCATCACACTGGAAGACTCCAGGTCAGGA GCCACTTGCCACCCTGCACACTGGCCTGCTGTGCCCCA | 309 |
| | TGGGGCACAGCAGGCCAGTGTGCAGGGTGGCAAGTGGCTCC TGACCTGGAGTCTTCCAGTGTGATGATGGTGAGGATGGGCCT CCGGTTCATGCCGCCCATGCAGGAACTGTTACACATGT | 310 |
| | CATCATCACACTGGAAG | 311 |
| | CTTCCAGTGTGATGATG | 312 |
| CTG-CAG Leu-257 to Gln Li-Fraumeni syndrome | TGTGTAACAGTTCCTGCATGGGCGGCATGAACCGGAGGCCC ATCCTCACCATCATCACACTGGAAGACTCCAGGTCAGGAGCC ACTTGCCACCCTGCACACTGGCCTGCTGTGCCCCAGCC | 313 |
| | GGCTGGGGCACAGCAGGCCAGTGTGCAGGGTGGCAAGTGG CTCCTGACCTGGAGTCTTCCAGTGTGATGATGGTGAGGATGG GCCTCCGGTTCATGCCGCCCATGCAGGAACTGTTACACA | 314 |
| | CATCACACTGGAAGACT | 315 |
| | AGTCTTCCAGTGTGATG | 316 |
| CTG-CCG Leu-265 to Pro Li-Fraumeni syndrome | GACCTGATTTCCTTACTGCCTCTTGCTTCTCTTTTCCTATCCT GAGTAGTGGTAATCTACTGGGACGGAACAGCTTTGAGGTGCG TGTTTGTGCCTGTCCTGGGAGAGACCGGCGCACAGA | 317 |
| | TCTGTGCGCCGGTCTCTCCCAGGACAGGCACAAACACGCAC CTCAAAGCTGTTCCGTCCCAGTAGATTACCACTACTCAGGAT AGGAAAAGAGAAGCAAGAGGCAGTAAGGAAATCAGGTC | 318 |
| | TAATCTACTGGGACGGA | 319 |
| | TCCGTCCCAGTAGATTA | 320 |
| gCGT-TGT Arg-273 to Cys Li-Fraumeni syndrome | TGCTTCTCTTTTCCTATCCTGAGTAGTGGTAATCTACTGGGAC GGAACAGCTTTGAGGTGCGTGTTTGTGCCTGTCCTGGGAGA GACCGGCGCACAGAGGAAGAGAATCTCCGCAAGAAAG | 321 |
| | CTTTCTTGCGGAGATTCTCTTCCTCTGTGCGCCGGTCTCTCC CAGGACAGGCACAAACACGCACCTCAAAGCTGTTCCGTCCCA GTAGATTACCACTACTCAGGATAGGAAAAGAGAAGCA | 322 |
| | TTGAGGTGCGTGTTTGT | 323 |
| | ACAAACACGCACCTCAA | 324 |
| TGT-TAT Cys-275 to Tyr Li-Fraumeni syndrome | CTTTTCCTATCCTGAGTAGTGGTAATCTACTGGGACGGAACA GCTTTGAGGTGCGTGTTTGTGCCTGTCCTGGGAGAGACCGG CGCACAGAGGAAGAGAATCTCCGCAAGAAAGGGGAGCC | 325 |
| | GGCTCCCCTTTCTTGCGGAGATTCTCTTCCTCTGTGCGCCGG TCTCTCCCAGGACAGGCACAAACACGCACCTCAAAGCTGTTC CGTCCCAGTAGATTACCACTACTCAGGATAGGAAAAG | 326 |
| | GCGTGTTTGTGCCTGTC | 327 |
| | GACAGGCACAAACACGC | 328 |
| CCT-CTT Pro-278 to Leu Breast cancer | TCCTGAGTAGTGGTAATCTACTGGGACGGAACAGCTTTGAGG TGCGTGTTTGTGCCTGTCCTGGGAGAGACCGGCGCACAGAG GAAGAGAATCTCCGCAAGAAAGGGGAGCCTCACCACGA | 329 |
| | TCGTGGTGAGGCTCCCCTTTCTTGCGGAGATTCTCTTCCTCT | 330 |

TABLE 11-continued p53 Mutations and Genome-Correcting Oligos

| Clinical Phenotype & Mutation | Correcting Oligos | SEQ ID NO: |
|---|---|---|
| | GTGCGCCGGTCTCTCCCAGGACAGGCACAAACACGCACCTC AAAGCTGTTCCGTCCCAGTAGATTACCACTACTCAGGA | |
| | TGCCTGTCCTGGGAGAG | 331 |
| | CTCTCCCAGGACAGGCA | 332 |
| AGA-AAA Arg-280 to Lys Glioma | GTAGTGGTAATCTACTGGGACGGAACAGCTTTGAGGTGCGTG TTTGTGCCTGTCCTGGGAGAGACCGGCGCACAGAGGAAGAG AATCTCCGCAAGAAAGGGGAGCCTCACCACGAGCTGCC | 333 |
| | GGCAGCTCGTGGTGAGGCTCCCCTTTCTTGCGGAGATTCTCT TCCTCTGTGCGCCGGTCTCTCCCAGGACAGGCACAAACACG CACCTCAAAGCTGTTCCGTCCCAGTAGATTACCACTAC | 334 |
| | TCCTGGGAGAGACCGGC | 335 |
| | GCCGGTCTCTCCCAGGA | 336 |
| GAA-GCA GTu-286 to Ala Adrenocortical carcinoma | GGAACAGCTTTGAGGTGCGTGWTTGTGCCTGTCCTGGGAGA GACCGGCGCACAGAGGAAGAGAATCTCCGCAAGAATTAGGGGA GCCTCACCACGAGCTGCCCCCAGGGAGCACTAAGCGAGG | 337 |
| | CCTCGCTTAGTGCTCCCTGGGGGCAGCTCGTGGTGAGGCTC CCCTTTCTTGCGGAGATTCTCTTCCTCTGTGCGCCGGTCTCT CCCAGGACAGGCACAAACACGCACCTCAAAGCTGTTCC | 338 |
| | AGAGGAAGAGAATCTCC | 339 |
| | GGAGATTCTCTTCCTCT | 340 |
| CGA-CCA Arg-306 to Pro Rhabdomyosarcoma | AAGAGAATCTCCGCAAGAAAGGGGAGCCTCACCACGAGCTG CCCCCAGGGAGCACTAAGCGAGGTAAGCAAGCAGGACAAGA AGCGGTGGAGGAGACCAAGGGTGCAGTTATGCCTCAGAT | 341 |
| | ATCTGAGGCATAACTGCACCCTTGGTCTCCTCCACCGCTTCT TGTCCTGCTTGCTTACCTCGCTTAGTGCTCCCTGGGGCAGC TCGTGGTGAGGCTCCCCTTTCTTGCGGAGATTCTCTT | 342 |
| | CACTAAGCGAGGTAAGC | 343 |
| | GCTTACCTCGCTTAGTG | 344 |
| gCGA-TGA Arg-306 to Term Li-Fraumeni syndrome | GAAAGAGAATCTCCGCAAGAAAGGGGAGCCTCACCACGAGCT GCCCCCAGGGAGCACTAAGCCGAGGTAAGCAAGCAGGACAAG AAGCGGTGGAGGAGACCAAGGGTGCAGTTATGCCTCAGA | 345 |
| | TCTGAGGCATAACTGCACCCTTGGTCTCCTCCACCGCTTCTT GTCCTGCTTGCTTACCTCGCTTAGTGCTCCCTGGGGCAGCT CGTGGTGAGGCTCCCCTTTCTTGCGGAGATTCTCTTC | 346 |
| | GCACTAAGCCGAGGTAAG | 347 |
| | CTTACCTCGCTTAGTGC | 348 |
| gCGC-TGC Arg-337 to Cys Osteosarcoma | GGTACTGTGAATATACTTACTTCTCCCCCTCCTCTGTTGCTGC AGATCCGTGGGCGTGAGCGCTTCGAGATGTTCCGAGAGCTG AATGAGGCCTTGGAACTCAAGGATGCCCAGGCTGGGA | 349 |
| | TCCCAGCCTGGGCATCCTTGAGTTCCAAGGCCTCATTCAGCT CTCGGAACATCTCGAAGCGCTCACGCCCACGGATCTGCAGC AACAGAGGAGGGGGAGAAGTAAGTATATTCACAGTACC | 350 |
| | GGCGTGAGCGCTTCGAG | 351 |
| | CTCGAAGCGCTCACGCC | 352 |
| CTG-CCG Leu-344 to Pro Li-Fraumeni syndrome | CTCTCCCCCTCCTCTGTTGCTGCAGATCCGTGGGCGTGAGCGC TTCGAGATGTTCCGAGAGCTGAATGAGGCCTTGGAACTCAAG GATGCCCAGGCTGGGAAGGAGCCAGGGGGAGCAGGGC | 353 |
| | GCCCTGCTCCCCCCTGGCTCCTTCCCAGCCTGGGCATCCTT GAGTTCCAAGGCCTCATTCAGCTCTCGGAACATCTCGAAGCG CTCACGCCCACGGATCTGCAGCAACAGAGGAGGGGGAG | 354 |

TABLE 11-continued p53 Mutations and Genome-Correcting Oligos

| Clinical Phenotype & Mutation | Correcting Oligos | SEQ ID NO: |
|---|---|---|
| | CCGAGAGCTGAATGAGG | 355 |
| | CCTCATTCAGCTCTCGG | 356 |

EXAMPLE 6

Beta Globin

Hemoglobin, the major protein in the red blood cell, binds oxygen reversibly and is responsible for the cells' capacity to transport oxygen to the tissues. In adults, the major hemoglobin is hemoglobin A, a tetrameric protein consisting of two identical alpha globin chains and two beta globin chains. Disorders involving hemoglobin are among the most common genetic disorders worldwide, with approximately 5% of the world's population being carriers for clinically important hemoglobin mutations. Approximately 300,000 severely affected homozygotes or compound heterozygotes are born each year.

Mutation of the glutamic acid at position 7 in beta globin to valine causes sickle cell anemia, the clinical manifestations of which are well known. Mutations that cause absence of beta chain cause beta-zero-thalassemia. Reduced amounts of detectable beta globin causes beta-plus-thalassemia. For clinical purposes, beta-thalassemia is divided into thalassemia major (transfusion dependent), thalassemia intermedia (of intermediate severity), and thalassemia minor (asymptomatic). Patients with thalassemia major present in the first year of life with severe anemia; they are unable to maintain a hemoglobin level about 5 gm/dl.

The beta-thalassemias were among the first human genetic diseases to be examined by means of recombinant DNA analysis. Baysal et al., *Hemoglobin* 19(3-4):213-36 (1995) and others provide a compendium of mutations that result in beta-thalassemia.

Hemoglobin disorders were among the first to be considered for gene therapy. Transcriptional silencing of genes transferred into hematopoietic stem cells, however, poses one of the most significant challenges to its success. If the transferred gene is not completely silenced, a progressive decline in gene expression is often observed. Position effect variegation (PEV) and silencing mechanisms may act on a transferred globin gene residing in chromatin outside of the normal globin locus during the important terminal phases of erythroblast development when globin transcripts normally accumulate rapidly despite heterochromatization and shutdown of the rest of the genome. The attached table discloses the correcting oligonucleotide base sequences for the beta globin oligonucleotides of the invention.

TABLE 12

Beta Globin Mutations and Genome-Correcting Oligos

| Clinical Phenotype & Mutation | Correcting Oligos | SEQ ID NO: |
|---|---|---|
| Sickle Cell Anemia GLU-7-VAL GAG to GTG | TCTGACACAACTGTGTTCACTAGCAACCTCAAACAGACACCA TGGTGCACCTGACTCCTGAGGAGAAGTCTGCCGTTACTGCC CTGTGGGGCAAGGTGAACGTGGATGAAGTTGGTGGTGA | 357 |
| | TCACCACCAACTTCATCCACGTTCACCTTGCCCCACAGGGCA GTAACGGCAGACTTCTCCTCAGGAGTCAGGTGCACCATGGT GTCTGTTTGAGGTTGCTAGTGAACACAGTTGTGTCAGA | 358 |
| | GACTCCTGAGGAGAAGT | 359 |
| | ACTTCTCCTCAGGAGTC | 360 |
| Thalassaemia Beta MET-0-ARG ATG to AGG | CTATTGCTTACATTTGCTTCTGACACAACTGTGTTCACTAGCA ACCTCAAACAGACACCATGGTGCACCTGACTCCTGAGGAGA AGTCTGCCGTTACTGCCCTGTGGGGCAAGGTGAACGT | 361 |
| | ACGTTCACCTTGCCCCACAGGGCAGTAACGGCAGACTTCTC CTCAGGAGTCAGGTGCACCATGGTGTCTGTTTGAGGTTGCT AGTGAACACAGTTGTGTCAGAAGCAAATGTAAGCAATAG | 362 |
| | AGACACCATGGTGCACC | 363 |
| | GGTGCACCATGGTGTCT | 364 |
| Thalassaemia Beta MET-0-ILE ATG to ATA | TATTGCTTACATTTGCTTCTGACACAACTGTGTTCACTAGCAA CCTCAAACAGACACCATGGTGCACCTGACTCCTGAGGAGAA GTCTGCCGTTACTGCCCTGTGGGGCAAGGTGAACGTG | 365 |
| | CACGTTCACCTTGCCCCACAGGGCAGTAACGGCAGACTTCT | 366 |

TABLE 12-continued

Beta Globin Mutations and Genome-Correcting Oligos

| Clinical Phenotype & Mutation | Correcting Oligos | SEQ ID NO: |
|---|---|---|
| | CCTCAGGAGTCAGGTGCACCATGGTGTCTGTTTGAGGTTGC<br>TAGTGAACACAGTTGTGTCAGAAGCAAATGTAAGCAATA | |
| | GACACCATGGTGCACCT | 367 |
| | AGGTGCACCATGGTGTC | 368 |
| Thalassaemia Beta<br>MET-0-ILE<br>ATG to ATT | TATTGCTTACATTTGCTTCTGACACAACTGTGTTCACTAGCAA<br>CCTCAAACAGACACCATGGTGCACCTGACTCCTGAGGAGAAT<br>GTCTGCCGTTACTGCCCTGTGGGGCAAGGTGAACGTG | 369 |
| | CACGTTCACCTTGCCCCACAGGGCAGTAACGGCAGACTTCT<br>CCTCAGGAGTCAGGTGCACCATGGTGTCTGTTTGAGGTTGC<br>TAGTGAACACAGTTGTGTCAGAAGCAAATGTAAGCAATA | 370 |
| | GACACCATGGTGCACCT | 371 |
| | AGGTGCACCATGGTGTC | 372 |
| Thalassaemia Beta<br>MET-0-LYS<br>ATG to AAG | CTATTGCTTACATTTGCTTCTGACACAACTGTGTTCACTAGCA<br>ACCTCAAACAGACACCATGGTGCACCTGACTCCTGAGGAGA<br>AGTCTGCCGTTACTGCCCTGTGGGGCAAGGTGAACGT | 373 |
| | ACGTTCACCTTGCCCCACAGGGCAGTAACGGCAGACTTCTC<br>CTCAGGAGTCAGGTGCACCATGGTGTCTGTTTGAGGTTGCT<br>AGTGAACACAGTTGTGTCAGAAGCAAATGTAAGCAATAG | 374 |
| | AGACACCATGGTGCACC | 375 |
| | GGTGCACCATGGTGTCT | 376 |
| Thalassaemia Beta<br>MET-0-THR<br>ATG to ACG | CTATTGCTTACATTTGCTTCTGACACAACTGTGTTCACTAGCA<br>ACCTCAAACAGACACCATGGTGCACCTGACTCCTGAGGAGA<br>AGTCTGCCGTTACTGCCCTGTGGGGCAAGGTGAACGT | 377 |
| | ACGTTCACCTTGCCCCACAGGGCAGTAACGGCAGACTTCTC<br>CTCAGGAGTCAGGTGCACCATGGTGTCTGTTTGAGGTTGCT<br>AGTGAACACAGTTGTGTCAGAAGCAAATGTAAGCAATAG | 378 |
| | AGACACCATGGTGCACC | 379 |
| | GGTGCACCATGGTGTCT | 380 |
| Thalassaemia Beta<br>MET-0-VAL<br>ATG to GTG | TCTATTGCTTACATTTGCTTCTGACACAACTGTGTTCACTAGC<br>AACCTCAAACAGACACCATGGTGCACCTGACTCCTGAGGAG<br>AAGTCTGCCGTTACTGCCCTGTGGGGCAAGGTGAACG | 381 |
| | CGTTCACCTTGCCCCACAGGGCAGTAACGGCAGACTTCTCC<br>TCAGGAGTCAGGTGCACCATGGTGTCTGTTTGAGGTTGCTAG<br>TGAACACAGTTGTGTCAGAAGCAAATGTAAGCAATAGA | 382 |
| | CAGACACCATGGTGCAC | 383 |
| | GTGCACCATGGTGTCTG | 384 |
| Thalassaemia Beta<br>TRP-16-Term<br>TGG to TGA | TCAAACAGACACCATGGTGCACCTGACTCCTGAGGAGAAGT<br>CTGCCGTTACTGCCCTGTGGGGCAAGGTGAACGTGGATGAA<br>GTTGGTGGTGAGGCCCTGGGCAGGTTGGTATCAAGGTTA | 385 |
| | TAACCTTGATACCAACCTGCCCAGGGCCTCACCACCAACTTC<br>ATCCACGTTCACCTTGCCCCACAGGGCAGTAACGGCAGACT<br>TCTCCTCAGGAGTCAGGTGCACCATGGTGTCTGTTTGA | 386 |
| | GCCCTGTGGGGCAAGGT | 387 |
| | ACCTTGCCCCACAGGGC | 388 |
| Thalassaemia Beta<br>TRP-16-Term<br>TGG to TAG | CTCAAACAGACACCATGGTGCACCTGACTCCTGAGGAGAAG<br>TCTGCCGTTACTGCCCTGTGGGGCAAGGTGAACGTGGATGA<br>AGTTGGTGGTGAGGCCCTGGGCAGGTTGGTATCAAGGTT | 389 |
| | AACCTTGATACCAACCTGCCCAGGGCCTCACCACCAACTTCA<br>TCCACGTTCACCTTGCCCCACAGGGCAGTAACGGCAGACTT<br>CTCCTCAGGAGTCAGGTGCACCATGGTGTCTGTTTGAG | 390 |

TABLE 12-continued

Beta Globin Mutations and Genome-Correcting Oligos

| Clinical Phenotype & Mutation | Correcting Oligos | SEQ ID NO: |
|---|---|---|
| | TGCCCTGTGGGGCAAGG | 391 |
| | CCTTGCCCCACAGGGCA | 392 |
| Thalassaemia Beta LYS-18-Term AAG to TAG | ACAGACACCATGGTGCACCTGACTCCTGAGGAGAAGTCTGC CGTTACTGCCCTGTGGGGCAAGGTGAACGTGGATGAAGTTG GTGGTGAGGCCCTGGGCAGGTTGGTATCAAGGTTACAAG | 393 |
| | CTTGTAACCTTGATACCAACCTGCCCAGGGCCTCACCACCAA CTTCATCCACGTTCACCTTGCCCCACAGGGCAGTAACGGCA GACTTCTCCTCAGGAGTCAGGTGCACCATGGTGTCTGT | 394 |
| | TGTGGGGCAAGGTGAAC | 395 |
| | GTTCACCTTGCCCCACA | 396 |
| Thalassaemia Beta ASN-20-SER AAC to AGC | CCATGGTGCACCTGACTCGTGAGGAGAAGTCTGCCGTTACT GCCCTGTGGGGCAAGGTGAACGTGGATGAAGTTGGTGGTGA GGCCCTGGGCAGGTTGGTATCAAGGTTACAAGACAGGTT | 397 |
| | AACCTGTCTTGTAACCTTGATACCAACCTGCCCAGGGCCTCA CCACCAACTTCATCCACGTTCACCTTGCCCCACAGGGCAGTA ACGGCAGACTTCTCCTCAGGAGTCAGGTGCACCATGG | 398 |
| | CAAGGTGAACGTGGATG | 399 |
| | CATCCACGTTCACCTTG | 400 |
| Thalassaemia Beta GLU-23-ALA GAA to GCA | ACCTGACTCCTGAGGAGAAGTCTGCCGTTACTGCCCTGTGG GGCAAGGTGAACGTGGATGAAGTTGGTGGTGAGGCCCTGG GCAGGTTGGTATCAAGGTTACAAGACAGGTTTAAGGAGAC | 401 |
| | GTCTCCTTAAACCTGTCTTGTAACCTTGATACCAACCTGCCC AGGGCCTCACCACCAACTTCATCCACGTTCACCTTGCCCCAC AGGGCAGTAACGGCAGACTTCTCCTCAGGAGTCAGGT | 402 |
| | CGTGGATGAAGTTGGTG | 403 |
| | CACCAACTTCATCCACG | 404 |
| Thalassaemia Beta GLU-23-term GAA to TAA | CACCTGACTCCTGAGGAGAAGTCTGCCGTTACTGCCCTGTG GGGCAAGGTGAACGTGGATGAAGTTGGTGGTGAGGCCCTG GGCAGGTTGGTATCAAGGTTACAAGACAGGTTTAAGGAGA | 405 |
| | TCTCCTTAAACCTGTCTTGTAACCTTGATACCAACCTGCCCA GGGCCTCACCACCAACTTCATCCACGTTCACCTTGCCCCACA GGGCAGTAACGGCAGACTTCTCCTCAGGAGTCAGGTG | 406 |
| | ACGTGGATGAAGTTGGT | 407 |
| | ACCAACTTCATCCACGT | 408 |
| Thalassaemia Beta GLU-27-LYS GAG to AAG | GAGGAGAAGACTGCTGTCAATGCCCTGTGGGGCAAAGTGAA CGTGGATGCAGTTGGTGGTGAGGCCCTGGGCAGGTTGGTAT CAAGGTTATAAGAGAGGCTCAAGGAGGCAAATGGAAACT | 409 |
| | AGTTTCCATTTGCCTCCTTGAGCCTCTCTTATAACCTTGATAC CAACCTGCCCAGGGCCTCACCACCAACTGCATCCACGTTCA CTTTGCCCCACAGGGCATTGACAGCAGTCTTCTCCTC | 410 |
| | TTGGTGGTGAGGCCCTG | 411 |
| | CAGGGCCTCACCACCAA | 412 |
| Thalassaemia Beta GLU-27-Term GAG to TAG | GAGGAGAAGACTGCTGTCAATGCCCTGTGGGGCAAAGTGAA CGTGGATGCAGTTGGTGGTGAGGCCCTGGGCAGGTTGGTAT CAAGGTTATAAGAGAGGCTCAAGGAGGCAAATGGAAACT | 413 |
| | AGTTTCCATTTGCCTCCTTGAGCCTCTCTTATAACCTTGATAC CAACCTGCCCAGGGCCTCACCACCAACTGCATCCACGTTCA CTTTGCCCCACAGGGCATTGACAGCAGTCTTCTCCTC | 414 |

TABLE 12-continued

Beta Globin Mutations and Genome-Correcting Oligos

| Clinical Phenotype & Mutation | Correcting Oligos | SEQ ID NO: |
|---|---|---|
| | TTGGTGGTGAGGCCCTG | 415 |
| | CAGGGCCTCACCACCAA | 416 |
| Thalassaemia Beta ALA-28-SER GCC to TCC | GAGAAGACTGCTGTCAATGCCCTGTGGGGCAAAGTGAACGT GGATGCAGTTGGTGGTGAGGCCCTGGGCAGGTTGGTATCAA GGTTATAAGAGAGGCTCAAGGAGGCAAATGGAAACTGGG | 417 |
| | CCCAGTTTCCATTTGCCTCCTTGAGCCTCTCTTATAACCTTGA TACCAACCTGCCCAGGGCCTCACCACCAACTGCATCCACGT TCACTTTGCCCCACAGGGCATTGACAGCAGTCTTCTC | 418 |
| | GTGGTGAGGCCCTGGGC | 419 |
| | GCCCAGGGCCTCACCAC | 420 |
| Thalassaemia Beta ARG-31-THR AGG to ACG | CTGTCAATGCCCTGTGGGGCAAAGTGAACGTGGATGCAGTT GGTGGTGAGGCCCTGGGCAGGTTGGTATGAAGGTTATAAGA GAGGCTCAAGGAGGCAAATGGAAACTGGGCATGTGTAGA | 421 |
| | TCTACACATGCCCAGTTTCCATTTGCCTCCTTGAGCCTCTCTT ATAACCTTGATACCAACCTGCCCAGGGCCTCACCACCAACTG CATCCACGTTCACTTTGCCCCACAGGGCATTGACAG | 422 |
| | CCTGGGCAGGTTGGTAT | 423 |
| | ATACCAACCTGCCCAGG | 424 |
| Thalassaemia Beta Leu-33-GLN CTG to CAG | TGGGTTTCTGATAGGCACTGACTCTCTGTCCCTTGGGCTGTT TTCCTACCCTCAGATTACTGGTGGTCTACCCTTGGACCCAGA GGTTCTTTGAGTCCTTTGGGGATCTGTCCTCTCCTGA | 425 |
| | TCAGGAGAGGAGAGATCCCCAAAGGACTCAAAGAACCTCTG GGTCCAAGGGTAGACCACCAGTAATCTGAGGGTAGGAAAAC AGCCCAAGGGACAGAGAGTCAGTGCCTATCAGAAACCCA | 426 |
| | CAGATTACTGGTGGTCT | 427 |
| | AGACCACCAGTAATCTG | 428 |
| Thalassaemia Beta TYR-36-Term TAC to TAA | ATAGGCACTGACTCTCTGTCCCTTGGGCTGTTTTCCTACCCT CAGATTACTGGTGGTCTACCCTTGGACCCAGAGGTTCTTTGA GTCCTTTGGGGATCTGTCCTCTCCTGATGCTGTTATG | 429 |
| | CATAACAGCATCAGGAGAGGACAGATCCCCAAAGGACTCAAA GAACCTCTGGGTCCAAGGGTAGACCACCAGTAATCTGAGGG TAGGAAAACAGCCCAAGGGACAGAGAGTCAGTGCCTAT | 430 |
| | GTGGTCTACCCTTGGAC | 431 |
| | GTCCAAGGGTAGACCAC | 432 |
| Thalassaemia Beta TRP-38-Term TGG to TGA | ACTGACTCTCTGTCCCTTGGGCTGTTTTCCTACCCTCAGATT ACTGGTGGTCTACCCGTTGGACCCAGAGGTTCTTTGAGTCCTT TGGGGATCTGTCCTCTCCTGATGCTGTTATGGGCAAC | 433 |
| | GTTGCCCATAACAGCATCAGGAGAGGACAGATCCCCAAAGG ACTCAAAGAACCTCTGGGTCCAAGGGTAGACCACCAGTAATC TGAGGGTAGGAAAACAGCCCAAGGGACAGAGAGTCAGT | 434 |
| | TACCCTTGGACCCAGAG | 435 |
| | CTCTGGGTCCAAGGGTA | 436 |
| Thalassaemia Beta TRP-38-Term TGG to TAG | CACTGACTCTCTGTCCCTTGGGCTGTTTTCCTACCCTCAGAT TACTGGTGGTCTACCCTTGGACCCAGAGGTTCTTGAGTCCT TTGGGGATCTGTCCTCTCCTGATGCTGTTATGGGCAA | 437 |
| | TTGCCCATAACAGCATCAGGAGAGGACAGATCCCCAAAGGA CTCAAAGAACCTCTGGGTCCAAGGGTAGACCACCAGTAATCT GAGGGTAGGAAAACAGCCCAAGGGACAGAGAGTCAGTG | 438 |

TABLE 12-continued

Beta Globin Mutations and Genome-Correcting Oligos

| Clinical Phenotype & Mutation | Correcting Oligos | SEQ ID NO: |
|---|---|---|
| | CTACCCTTGGACCCAGA | 439 |
| | TCTGGGTCCAAGGGTAG | 440 |
| Thalassaemia Beta GLN-40-Term CAG-TAG | ACTCTCTGTCCCTTGGGCTGTTTTCCTACCCTCAGATTACTG GTGGTCTACCCTTGGACCCAGAGGTTCTTTGAGTCCTTTGGG GATCTGTCCTCTCCTGATGCTGTTATGGGCAACCCTA | 441 |
| | TAGGGTTGCCCATAACAGCATCAGGAGAGGACAGATCCCCA AAGGACTCAAAGAACCTCTGGGTCCAAGGGTAGACCACCAG TAATCTGAGGGTAGGAAAACAGCCCAAGGGAGAGAGAGT | 442 |
| | CTTGGACCCAGAGGTTC | 443 |
| | GAACCTCTGGGTCCAAG | 444 |
| Thalassaemia Beta GLU-44-Term GAG to TAG | TTGGGCTGTTTTCCTACCCTCAGATTACTGGTGGTCTACCCT TGGACCCAGAGGTTCTTTGAGTCCTTTGGGGATCTGTCCTCT CCTGATGCTGTTATGGGCAACCCTAAGGTGAAGGCTC | 445 |
| | GAGCCTTCACCTTAGGGTTGCCCATAACAGCATCAGGAGAG GACAGATCCCCAAAGGACTCAAAGAACCTGTGGGTCCAAGG GTAGACCACCAGTAATCTGAGGGTAGGAAAACAGCCCAA | 446 |
| | GGTTCTTTGAGTCCTTT | 447 |
| | AAAGGACTCAAAGAACC | 448 |
| Thalassaemia Beta LYS-62-Term AAG to TAG | TTCTTTGAGTCCTTTGGGGATCTGTCCTCTCCTGATGCTGTTA TGGGCAACCCTAAGGTGAAGGCTCATGGCAAGAAGGTGCTA GGTGCCTTTAGTGATGGCCTGGCTCACCTGGACAACC | 449 |
| | GGTTGTCCAGGTGAGCCAGGCCATCACTAAAGGCACCTAGC ACCTTCTTGCCATGAGCCTTCACCTTAGGGTTGCCCATAACA GCATCAGGAGAGGACAGATCCCCAAAGGACTCAAAGAA | 450 |
| | CTAAGGTGAAGGCTCAT | 451 |
| | ATGAGCCTTCACCTTAG | 452 |
| Thalassaemia Beta SER-73-ARG AGT to AGA | TGCTGTTATGGGCAACCCTAAGGTGAAGGCTCATGGCAAGA AGGTGCTAGGTGCCTTTAGTGATGGCCTGGCTCACCTGGAC AACCTCAAGGGCACTTTTTCTCAGCTGAGTGAGCTGCAC | 453 |
| | GTGCAGCTCACTCAGCTGAGAAAAAGTGCCCTTGAGGTTGTC CAGGTGAGCCAGGCCATCACTAAAGGCACCTAGCACCTTCT TGCCATGAGCCTTCACCTTAGGGTTGCCCATAACAGCA | 454 |
| | GCCTTTAGTGATGGCCT | 455 |
| | AGGCCATCACTAAAGGC | 456 |
| Haemolylic Anaemia GLY-75-VAL GGC to GTC | TTATGGGCAACCCTAAGGTGAAGGCTCATGGCAAGAAGGTG CTAGGTGCCTTTTAGTGATGGCCTGGCTCACCTGGACAACCT CAAGGGCACTTTTTCTCAGCTGAGTGAGCTGCACTGTGA | 457 |
| | TCACAGTGCAGCTCACTCAGCTGAGAAAAAGTGCCCTTGAG GTTGTCCAGGTGAGCCAGGCCATCACTAAAGGCACCTAGCA CCTTCTTGCCATGAGCCTTCACCTTAGGGTTGCCCATAA | 458 |
| | TAGTGATGGCCTGGCTC | 459 |
| | GAGCCAGGCCATCACTA | 460 |
| Thalassaemia Beta GLU-91-Term GAG to TAG | GCCTTTAGTGATGGCCTGGCTCACCTGGACAACCTCAAGGG CACCTTTGCCACACTGAGTGAGCTGCACTGTGACAAGCTGC ACGTGGATCCTGAGAACTTCAGGGTGAGTCTATGGGACC | 461 |
| | GGTCCCATAGACTCACCCTGAAGTTCTCAGGATCCACGTGCA GCTTGTCACAGTGCAGCTCACTCAGTGTGGCAAAGGTGCCC TTGAGGTTGTCCAGGTGAGCCAGGCCATCACTAAAGGC | 462 |

TABLE 12-continued

Beta Globin Mutations and Genome-Correcting Oligos

| Clinical Phenotype & Mutation | Correcting Oligos | SEQ ID NO: |
|---|---|---|
| | CACTGAGTGAGCTGCAC | 463 |
| | GTGCAGCTCACTCAGTG | 464 |
| Thalassaemia Beta VAL-99-MET GTG to ATG | CTGGACAACCTCAAGGGCACTTTTTCTCAGCTGAGTGAGCTG CACTGTGACAAGCTGCACGTGGATCCTGAGAACTTCAGGGT GAGTCCAGGAGATGCTTCACTTTTCTCTTTTTACTTTC | 465 |
| | GAAAGTAAAAAGAGAAAAGTGAAGCATCTCCTGGACTCACCC TGAAGTTCTCAGGATCCACGTGCAGCTTGTCACAGTGCAGCT CACTCAGCTGAGAAAAAGTGCCCTTGAGGTTGTCCAG | 466 |
| | AGCTGCACGTGGATCCT | 467 |
| | AGGATCCACGTGCAGCT | 468 |
| Thalassaemia Beta LEU-111-PRO CTG-CCG | CCCTTTTGCTAATCATGTTCATACCTCTTATCTTCCTCCCACA GCTCCTGGGCAACGTGCTGGTCTGTGTGCTGGCCCATCACT TTGGCAAAGAATTCACCCCACCAGTGCAGGCTGCCTA | 469 |
| | TAGGCAGCCTGCACTGGTGGGGTGAATTCTTTGCCAAAGTG ATGGGCCAGCACACAGACCAGCACGTTGCCCAGGAGCTGTG GGAGGAAGATAAGAGGTATGAACATGATTAGCAAAAGGG | 470 |
| | CAACGTGCTGGTCTGTG | 471 |
| | CACAGACCAGCACGTTG | 472 |
| Thalassaemia Beta CYS-113-Term TGT to TGA | GCTAATCATGTTCATACCTCTTATCTTCCTCCCACAGCTCCTG GGCAACGTGCTGGTCTGTGTGCTGGCCCATCACTTTGGCAA AGAATTCACCCCACCAGTGCAGGCTGCCTATCAGAAA | 473 |
| | TTTCTGATAGGCAGCCTGCACTGGTGGGGTGAATTCTTTGCC AAAGTGATGGGCCAGCACACAGACCAGCACGTTGCCCAGGA GCTGTGGGAGGAAGATAAGAGGTATGAACATGATTAGC | 474 |
| | CTGGTCTGTGTGCTGGC | 475 |
| | GCCAGCACACAGACCAG | 476 |
| Thalassaemia Beta LEU-115-PRO CTG to CCG | TCATGTTCATACCTCTTATCTTCCTCCCACAGCTCCTGGGCA ACGTGCTGGTCTGTGTGCTGGCCCATCACTTTGGCAAAGAAT TCACCCCACCAGTGCAGGCTGCCTATCAGAAAGTGGT | 477 |
| | ACCACTTTCTGATAGGCAGCCTGCACTGGTGGGGTGAATTCT TTGCCAAAGTGATGGGCCAGCACACAGACCAGCACGTTGCC CAGGAGCTGTGGGAGGAAGATAAGAGGTATGAACATGA | 478 |
| | CTGTGTGCTGGCCCATC | 479 |
| | GATGGGCCAGCACACAG | 480 |
| Thalassaemia Beta ALA-116-ASP GCC to GAC | TGTTCATACCTCTTATCTTCCTCCCACAGCTCCTGGGCAACG TGCTGGTCTGTGTGCTGGCCCATCACTTTGGCAAAGAATTCA CCCCACCAGTGCAGGCTGCCTATCAGAAAGTGGTGGC | 481 |
| | GCCACCACTTTCTGATAGGCAGCCTGCACTGGTGGGGTGAA TTCTTTGCCAAAGTGATGGGCCAGCACACAGACCAGCACGTT GCCCAGGAGCTGTGGGAGGAAGATAAGAGGTATGAACA | 482 |
| | TGTGCTGGCCCATCACT | 483 |
| | AGTGATGGGCCAGCACA | 484 |
| Thalassaemia Beta GLU-122-Term GAA to TAA | TTCCTCCCACAGCTCCTGGGCAACGTGCTGGTCTGTGTGCT GGCCCATCACTTTGGCAAAGAATTCACCCCACCAGTGCAGG CTGCCTATCAGAAAGTGGTGGCTGGTGTGGCTAATGCCC | 485 |
| | GGGCATTAGCCACACCAGCCACCACTTTCTGATAGGCAGCC TGCACTGGTGGGGTGAATTCTTTGCCAAAGTGATGGGCCAG CACACAGACCAGCACGTTGCCCAGGAGCTGTGGGAGGAA | 486 |

TABLE 12-continued

Beta Globin Mutations and Genome-Correcting Oligos

| Clinical Phenotype & Mutation | Correcting Oligos | SEQ ID NO: |
|---|---|---|
| | TTGGCAAAGAATTCACC | 487 |
| | GGTGAATTCTTTGCCAA | 488 |
| Thalassaemia Beta GLN-128-PRO CAG to CCG | GCAACGTGCTGGTCTGTGTGCTGGCCCATCACTTTGGCAAA GAATTCACCCCACCAGTGCAGGCTGCCTATCAGAAAGTGGT GGCTGGTGTGGCTAATGCCCTGGCCCACAAGTATCACTA | 489 |
| | TAGTGATACTTGTGGGCCAGGGCATTAGCCACACCAGCCAC CACTTTCTGATAGGCAGCCTGCACTGGTGGGGTGAATTCTTT GCCAAAGTGATGGGCCAGCACACAGACCAGCACGTTGC | 490 |
| | ACCAGTGCAGGCTGCCT | 491 |
| | AGGCAGCCTGCACTGGT | 492 |
| Thalassaemia Beta GLN-128-Term CAG to TAG | GGCAACGTGCTGGTCTGTGTGCTGGCCCATCACTTTGGCAA AGAATTCACCCCACCAGTGCAGGCTGCCTATCAGAAAGTGGT GGCTGGTGTGGCTAATGCCCTGGCCCACAAGTATCACT | 493 |
| | AGTGATACTTGTGGGCCAGGGCATTAGCCACACCAGCCACC ACTTTCTGATAGGCAGCCTGCACTGGTGGGGTGAATTCTTTG CCAAAGTGATGGGCCAGCACACAGACCAGCACGTTGCC | 494 |
| | CACCAGTGCAGGCTGCC | 495 |
| | GGCAGCCTGCACTGGTG | 496 |
| Thalassaemia Beta GLN-132-LYS CAG to AAG | GTCTGTGTGCTGGCCCATCACTTTGGCAAAGAATTCACCCCA CCAGTGCAGGCTGCCTATCAGAAAGTGGTGGCTGGTGTGGC TAATGCCCTGGCCCACAAGTATCACTAAGCTCGCTTTC | 497 |
| | GAAAGCGAGCTTAGTGATACTTGTGGGCCAGGGCATTAGCC ACACCAGCCACCACTTTCTGATAGGCAGCCTGCACTGGTGG GGTGAATTCTTTGCCAAAGTGATGGGCCAGCACACAGAC | 498 |
| | CTGCCTATCAGAAAGTG | 499 |
| | CACTTTCTGATAGGCAG | 500 |

EXAMPLE 7

Retinoblastoma

Retinoblastoma (RB) is an embryonic neoplasm of retinal origin. It almost always presents in early childhood and is often bilateral. The risk of osteogenic sarcoma is increased 500-fold in bilateral retinoblastoma patients, the bone malignancy being at sites removed from those exposed to radiation treatment of the eye tumor.

The retinoblastoma susceptibility gene (pRB; pRb) plays a pivotal role in the regulation of the cell cycle. pRB restrains cell cycle progression by maintaining a checkpoint in late $G_1$ that controls commitment of cells to enter S phase. The critical role that pRB plays in cell cycle regulation explains its status as archetypal tumor suppressor: loss of pRB function results in an inability to maintain control of the $G_1$ checkpoint; unchecked progression through the cell cycle is, in turn, a hallmark of neoplasia.

Blanquet et al., *Hum. Molec. Genet.* 4: 383-388 (1995) performed a mutation survey of the RB1 gene in 232 patients with hereditary or nonhereditary retinoblastoma. They systematically explored all 27 exons and flanking sequences, as well as the promoter. All types of point mutations were represented and found to be unequally distributed along the RB1 gene sequence. In the population studied, exons 3, 8, 18, and 19 were preferentially altered. The attached table discloses the correcting oligonucleotide base sequences for the retinoblastoma oligonucleotides of the invention.

TABLE 13 pRB Mutations and Genome-Correcting Oligos

| Clinical Phenotype Mutation | Correcting Oligos | SEQ ID NO: |
|---|---|---|
| Retinoblastoma Trp99Term TGG-TAG | AATATTTGATCTTTATTTTTTGTTCCCAGGGAGGTTATATTCAA AAGAAAAAGGAACTGTGGGAATCTGTATCTTTATTGCAGCA GTTGACCTAGATGAGATGTCGTTCACTTTTACTGA | 501 |

TABLE 13-continued pRB Mutations and Genome-Correcting Oligos

| Clinical Phenotype Mutation | Correcting Oligos | SEQ ID NO: |
|---|---|---|
| | TCAGTAAAAGTGAACGACATCTCATCTAGGTCAACTGCTGCA ATAAAGATACAGATTCCCCACAGTTCCTTTTTCTTTTGAAIATA ACCTCCCTGGGAACAAAAAATAAAGATCAAATATT | 502 |
| | GGAACTGTGGGGAATCT | 503 |
| | AGATTCCCCACAGTTCC | 504 |
| Retinoblastoma Glu137Asp GAA-GAT | ATTTACTTTTTTCTATTCTTTCCTTTGTAGTGTCCATAAATTCTT TAACTTACTAAAAGAAATTGATACCAGTACCAAAGTTGATAAT GCTATGTCAAGACTGTTGAAGAAGTATGAIGTA | 505 |
| | TACATCATACTTCTTCAACAGTCTTGACATAGCATTATCAACTT TGGTACTGGTATCAATTTCTTTTAGTAAGTTAAAGAATTTATGG ACACTACAAAGGAAAGAATAGAAAAAAGTAAAT | 506 |
| | CTAAAAGAAATTGATAC | 507 |
| | GTATCAATTTCTTTTAG | 508 |
| Retinoblastoma Glu137Term GAA-TAA | TGATTTACTTTTTTTCTATTCTTTCCTTTGTAGTGTCCATAAATT CTTTAACTTACTAAAAGAAATTGATACCAGTACCAAAGTTGAT AATGCTATGTCAAGACTGTTGAAGAAGTATGATG | 509 |
| | CATCATACTTCTTCAACAGTCTTGACATAGCATTATCAACTTT GGTACTGGTATCAATTTCTTTTAGTAAGTTAAAGAATTTATGG ACACTACAAAGGAAAGAATAGAAAAAAGTAAATCA | 510 |
| | TACTAAAAGAAATTGAT | 511 |
| | ATCAATTTCTTTTAGTA | 512 |
| Retinoblastoma Gln176Term CAA-TAA | AAAATGTTAAAAAGTCATAATGTTTTTCTTTTCAGGACATGTGA ACTTATATATTTGACACAACCCAGCAGTTCGTAAGTAGTTCAC AGAATGTTATTTTTCACTTAAAAAAAAAGATTTT | 513 |
| | AAAATCTTTTTTTTAAGTGAAAAATAAACATTCTGTGAACTACT TACGAACTGCTGGGTTGTGTCAAATATATAAGTTCACATGTCC TGAAAAGAAAAACATTATGACTTTTTAACATTTT | 514 |
| | ATTTGACACAACCCAGC | 515 |
| | GCTGGGTTGTGTCAAAT | 516 |
| Relinoblastoma lle185Thr ATA-ACA | TGATACATTTTTCCTGTTTTTTTCTGCTTTCTATTTGTTTAATA GGATATCTACTGAAATAAATTCTGCATTGGTGCTAAAAGTTTC TTGGATCACATTTTTATTAGCTAAAGGTAAGTT | 517 |
| | AACTTACCTTTAGCTAATAAAAATGTGATCCAAGAAACTTTTA GCACCAATGCAGAATTTATTTCAGTAGATATCCTATTAAACAA ATAGAAAGCAGAAAAAAAACAGGAAAAATGTATCA | 518 |
| | TACTGAAATAAATTCTG | 519 |
| | CAGAATTTATTTCAGTA | 520 |
| Retinoblastoma Gln207Term CAA-TAA | AAAGATCTGAATCTCTAACTTTCTTTAAAAATGTACATTTTTTT TTCAGGGGAAGTATTACAAATGGAAGATGATCTGGTGATTTC ATTTCAGTTAATGCTATGTGTCCTTGACTATTTTA | 521 |
| | TAAAATAGTCAAGGACACATAGCATTAACTGAAATGAAATCAC CAGATCATCTTCCATTTGTAATACTTCCCCTGAAAAAAAAAATG TACATTTTTAAAGAAAGTTAGAGATTCAGATCTTT | 522 |
| | AAGTATTACAAATGGAA | 523 |
| | TTCCATTTGTAATACTT | 524 |
| Retinoblastoma Arg251Term CGA to TGA | GTTCTTATCTAATTTACCACTTTTACAGAAACAGCTGTTATACC CATTAATGGTTCACCTCGAACACCCAGGCGAGGTCAGAACA GGAGTGCACGGATAGCAAAACAACTAGAAAATGATA | 525 |

TABLE 13-continued pRB Mutations and Genome-Correcting Oligos

| Clinical Phenotype Mutation | Correcting Oligos | SEQ ID NO: |
|---|---|---|
| | TATCATTTTCTAGTTGTTTTGCTATCCGTGCACTCCTGTTCTG ACCTCGCCTGGGTGTTCGAGGTGAACCATTAATGGGTATAAC AGCTGTTTCTGTAAAAGTGGTAAATTAGATAAGAAC | 526 |
| | GTTCACCTCGAACACCC | 527 |
| | GGGTGTTCGAGGTGAAC | 528 |
| Retinoblastoma Arg255Term CGA to TGA | TTTACCACTTTTACAGAAACAGCTGTTATACCCATTAATGGTT CACCTCGAACACCCAGGCGAGGTCAGAACAGGAGTGCACG GATAGCAAAACAACTAGAAAATGATACAAGAATTATTG | 529 |
| | CAATAATTCTTGTATCATTTTCTAGTTGTTTTGCTATCCGTGCA CTCCTGTTCTGACCTCGCCTGGGTGTTCGAGGTGAACCATTA ATGGGTATAACAGCTGTTTCTGTAAAAGTGGTAAA | 530 |
| | CACCCAGGCGAGGTCAG | 531 |
| | CTGACCTCGCCTGGGTG | 532 |
| Retinoblastoma Gln266Term CAA to TAA | ATTAATGGTTCACCTCGAACACCCAGGCGAGGTCAGAACAG GAGTGCACGGATAGCAAAACAACTAGAAAATGATACAAGAAT TATTGAAGTTCTCTGTAAAGAACATGAATGTAATATAG | 533 |
| | CTATATTACATTCATGTTCTTTACAGAGAACTTCAATAATTCTT GTATCATTTTCTAGTTGTTTTGCTATCCGTGCACTCCTGTTCT GACCTCGCCTGGGTGTTCGAGGTGAACCATTAAT | 534 |
| | TAGCAAAACAACTAGAA | 535 |
| | TTCTAGTTGTTTTGCTA | 536 |
| Retinoblastoma Arg320Term CGA to TGA | TGACATGTAAAGGATAATTGTCAGTGACTTTTTTCTTTCAAGG TTGAAAATCTTTCTAAACGATACGAAGAAATTTATCTTAAAAAT AAAGATCTAGATGCAAGATTATTTTTGGATCATG | 537 |
| | CATGATCCAAAAATAATCTTGCATCTAGATCTTTATTTTTAAGA TAAATTTCTTCGTATCGTTTAGAAAGATTTTCAACCTTGAAAGA AAAAAGTCACTGACAATTATCCTTTACATGTCA | 538 |
| | TTTCTAAACGATACGAA | 539 |
| | TTCGTATCGTTTAGAAA | 540 |
| Retinoblastoma Gln354Term CAG to TAG | ACAAATTGTAAATTTTCAGTATGAAGCTTGACTTCACTTATTGTT ATTTAGTTTTGAAACACAGAGAACACCACGAAAAAGTAACCTT GATGAAGAGGTGAATGTAATTCCTCCACACACTC | 541 |
| | GAGTGTGTGGAGGAATTACATTCACCTCTTCATCAAGGTTAC TTTTTCGTGGTGTTCTCTGTGTTTCAAAACTAAATAACAATAA GTGAAGTCATTCACATACTGAAAATTTACAATTTGT | 542 |
| | TTGAAACACAGAGAACA | 543 |
| | TGTTCTCTGTGTTTCAA | 544 |
| Retinoblastoma Arg358Gly CGA to GGA | TTTTCAGTATGIGAATGACTTCACTTATTGTTATTTAGTTTTGA AACACAGAGAACACCACGAAAAAGTAACCTTGATGAAGAGGT GAATGTAATTCCTCCACACACTCCAGTTAGGTATG | 545 |
| | CATACCTAACTGGAGTGTGTGGAGGAATTACATTCACCTCTT CATCAAGGTTACTTTTTCGTGGTGTTCTCTGTGTTTCAAAACT AAATAACAATAAGTGAAGTCATTCACATACTGAAAA | 546 |
| | GAACACCACGAAAAAGT | 547 |
| | ACTTTTTCGTGGTGTTC | 548 |
| Retinoblastoma Arg358Term CGA to TGA | TTTTCAGTATGTGAATGACTTCACTTATTGTTATTTATTTTTGA AACACAGAGAACACCACGAAAAAGTAACCTTGATGAAGAGGT GAATGTAATTCCTCCACACACTCCAGTTAGGTATG | 549 |

TABLE 13-continued pRB Mutations and Genome-Correcting Oligos

| Clinical Phenotype Mutation | Correcting Oligos | SEQ ID NO: |
|---|---|---|
| | CATACCTAACTGGAGTGTGTGGAGGAATTACATTCACCTCTT CATCAAGGTTACTTTTTCGTGGTGTTCTCTGTGTTTCAAAACT AAATAACAATAAGTGAAGTCATTCACATACTGAAAA | 550 |
| | GAACACCACGAAAAAGT | 551 |
| | ACTTTTTCGTGGTGTTC | 552 |
| Retinoblastoma Ser397Term TCA to TAA | CTGTTATGAACACTATCCAACAATTAATGATGATTTTAAATTCA GCAAGTGATCAACCTTCAGAAAATCTGATTTCCTATTTTAACG TAAGCCATATATGAAACATTATTTATTGTAATAT | 553 |
| | ATATTACAATAAATAATGTTTCATATATGGCTTACGTTAAAATA GGAAATCAGATTTTCTGAAGGTTGATCACTTGCTGAATTTAAA ATCATCATTAATTGTTGGATAGTGTTCATAACAG | 554 |
| | TCAACCTTCAGAAAATC | 555 |
| | GATTTTCTGAAGGTTGA | 556 |
| Retinoblastoma Arg445Term CGA to TGA | TTTCATAATTGTGATTTTCTAAAATAGCAGGCTCTTATTTTTCT TTTTGTTTGTTTGTAGCGATACAAACTTGGAGTTCGCTTGTAT TACCGAGTAATGGAATCCATGCTTAAATCAGTAA | 557 |
| | TTACTGATTTAAGCATGGATTCCATTACTCGGTAATACAAGCG AACTCCAAGTTTGTATCGCTACAAACAAACAAAAAGAAAAATA AGAGCCTGCTATTTTAGAAAATCACAATTATGAAA | 558 |
| | GTTTGTAGCGATACAAA | 559 |
| | TTTGTATCGCTACAAAC | 560 |
| Retinoblastoma Arg455Term CGA to TGA | GCTCTTATTTTTCTTTTTGTTTGTTTGTAGCGATACAAACTTGG AGTTCGCTTGTATTACCGAGTAATGGAATCCATGCTTAAATCA GTAAGTAAAAACAATATAAAAAAATTTCAGCCG | 561 |
| | CGGCTGAAATTTTTTATATTGTTTTTAACTTACTGATTTAAGC ATGGATTCCATTACTCGGTAATACAAGCGAACTCCAAGTTTGT ATCGCTACAAACAAACAAAAAGAAAAATAAGAGC | 562 |
| | TGTATTACCGAGTAATG | 563 |
| | CATTACTCGGTAATACA | 564 |
| Retinoblastoma Arg552Term CGA to TGA | ATCGAAAGTTTTATCAAAGCAGAAGGCAACTTGACAAGAGAA ATGATAAAACATTTAGAACGATGTGAACATCGAATCATGGAAT CCCTTGCATGGCTCTCAGTAAGTAGCTAAATAATTG | 565 |
| | CAATTATTTAGCTACTTACTGAGAGCCATGCAAGGGATTCCAT GATTCGATGTTCACATCGTTCTAAATGTTTTATCATTTCTCTTG TCAAGTTGCCTTCTGCTTTGATAAAACTTTCGAT | 566 |
| | ATTTAGAACGATGTGAA | 567 |
| | TTCACATCGTTCAAAT | 568 |
| Retinoblastoma Cys553Term TGT to TGA | AAGTTTTATCAAAGCAGAAGGCAACTTGACAAGAGAAATGATA AAACATTTAGAACGATGTGAACATCGAATCATGGAATCCCTTG CATGGCTCTCAGTAAGTAGCTAAATAATTGAAGAA | 569 |
| | TTCTTCAATTATTTAGCTACTTACTGAGAGCCATGCAAGGGAT TCCATGATTCGATGTTCACATCGTTCTAAATGTTTTATCATTTC TCTTGTCAAGTTGCCTTCTGCTTTGATAAAACTT | 570 |
| | GAACGATGTGAACATCG | 571 |
| | CGATGTTCACATCGTTC | 572 |
| Retinoblastoma Glu554Term GAA to TAA | AGTTTTATCAAAGCAGAAGGCAACTTGACAAGAGAAATGATAA ACATTTAGAACGATGTGAACATCGAATCATGGAATCCCTTG CATGGCTCTCAGTAAGTAGCTAAATAATTGAAGAAA | 573 |

TABLE 13-continued pRB Mutations and Genome-Correcting Oligos

| Clinical Phenotype Mutation | Correcting Oligos | SEQ ID NO: |
|---|---|---|
| | TTTCTTCAATTATTTAGCTACTTACTGAGAGCCATGCAAGGGA TTCCATGATTCGATGTTCACATCGTTCTAAATGTTTTATCATTT CTCTTGTCAAGTTGCCTTCTGCTTTGATAAAACT | 574 |
| | AACGATGTGAACATCGA | 575 |
| | TCGATGTTCACATCGTT | 576 |
| Retinoblastoma Ser567Leu TCA to TTA | TACCTGGGAAAATTATGCTTACTAATGTGGTTTTAATTTCATC ATGTTTCATATAGGATTCACCTTTATTTGATCTTATTAAACAAT CAAAGGACCGAGAAGGACCAACTGATCACCTTGA | 577 |
| | TCAAGGTGATCAGTTGGTCCTTCTCGGTCCTTTGATTGTTTAA TAAGATCAAATAAAGGTGAATCCTATATGAAACATGATGAAAT TAAAACCACATTAGTAAGCATAATTTTCCCAGGTA | 578 |
| | ATAGGATTCACCTTTAT | 579 |
| | ATAAAGGTGAATCCTAT | 580 |
| Retinoblastoma Gln575Term CAA to TAA | AATGTGGTTTTAATTTCATCATGTTTFCATATAGGATTCACCTTT ATTTGATCTTATTAAACAATCAAAGGACCGAGAAGGACCAACT GATCACCTTGAATCTGCTTGTCCTCTTAATCTTC | 581 |
| | GAAGATTAAGAGGACAAGCAGATTCAAGGTGATCAGTTGGTC CTTCTCGGTCCTTTGATTGTTTAATAAGATCAAATAAAGGTGA ATCCTATATGAAACATGATGAAATTAAAACCACATT | 582 |
| | TTATTAAACAATCAAAG | 583 |
| | CTTTGATTGTTTAATAA | 584 |
| Retinoblastoma Arg579Term CGA to TGA | ATTTCATCATGTTTCATATAGGATTCACCTTTATTTGATCTTAT TAAACAATCAAAGGACCGAGAAGGACCAACTGATCACCTTGA ATCTGCTTGTCCTCTTAATCTTCCTCTCCAGAATA | 585 |
| | TATTCTGGAGAGGAAGATTAAGAGGACAAGCAGATTCAAGGT GATCAGTTGGTCCTTCTCGGTCCTTTGATTGTTTAATAAGATC AAATAAAGGTGAATCCTATATGAAACATGATGAAAT | 586 |
| | CAAAGGACCGAGAAGGA | 587 |
| | TCCTTCTCGGTCCTTTG | 588 |
| Retinoblastoma Glu580Term GAA to TAA | TCATCATGTTTCATATAGGATTCACCTTTATTTGATCTTATTAA ACAATCAAAGGACCGAGAAGGACCAACTGATCACCTTGAATC TGCTTGTCCTCTTAATCTTCCTCTCCAGAATAATC | 589 |
| | GATTATTCTGGAGAGGAAGATTAAGAGGACAAGCAGATTCAA GGTGATCAGTTGGTCCTTCTCGGTCCTTTGATTGTTTAATAAG ATCAAATAAAGGTGAATCCTATATGAAACATGATGA | 590 |
| | AGGACCGAGAAGGACCA | 591 |
| | TGGTCCTTCTCGGTCCT | 592 |
| Retinoblastoma Ser634Term TCA to TGA | AGAAAAAGGTTCAACTACGCGTGTAAATTCTACTGCAAATG CAGAGACACAAGCAACCTCAGCCTTCCAGACCCAGAAGCCA TTGAAATCTACCTCTCTTTCACTGTTTTATAAAAAAGG | 593 |
| | CCTTTTTTATAAAACAGTGAAAGAGAGGTAGATTTCAATGGCT TCTGGGTCTGGAAGGCTGAGGTTGCTTGTGTCTCTGCATTTG CAGTAGAATTTACACGCGTAGTTGAACCTTTTTTCT | 594 |
| | AGCAACCTCAGCCTTCC | 595 |
| | GGAAGGCTGAGGTTGCT | 596 |
| Retinoblastoma Ala635Pro GCC to CCC | AAAAAAGGTTCAACTACGCGTGTAAATTCTACTGCAAATGCA GAGACACAAGCAACCTCAGCCTTCCAGACCCAGAAGCCATT GAAATCTACCTCTCTTTCACTGTTTTATAAAAAAGGTT | 597 |
| | AACCTTTTTTATAAAACAGTGAAAGAGAGGTAGATTTCAATGG | 598 |

TABLE 13-continued pRB Mutations and Genome-Correcting Oligos

| Clinical Phenotype Mutation | Correcting Oligos | SEQ ID NO: |
|---|---|---|
| | CTTCTGGGTCTGGAAGGCTGAGGTTGCTTGTGTCTCTGCATT TGCAGTAGAATTTACACGCGTAGTTGAACCTTTTTT | |
| | CAACCTCAGCCTTCCAG | 599 |
| | CTGGAAGGCTGAGGTTG | 600 |
| Retinoblastoma Gln639Term CAG to TAG | ACTACGCGTGTAAATTCTACTGCAAATGCAGAGACACAAGCA ACCTCAGCCTTCCAGACCCAGAAGCCATTGAAATCTACCTCT CTTTCACTGTTTTATAAAAAAGGTTAGTAGATGATTA | 601 |
| | TAATCATCTACTAACCTTTTTTATAAAACAGTGAAAGAGAGGT AGATTTCAATGGCTTCTGGGTCTGGAAGGCTGAGGTTGCTTG TGTCTCTGCATTTGCAGTAGAATTTACACGCGTAGT | 602 |
| | TCCAGACCCAGAAGCCA | 603 |
| | TGGCTTCTGGGTCTGGA | 604 |
| Retinoblastoma Leu657Pro CTA to CCA | TTGTAATTCAAAATGAACAGTAAAAATGACTAATTTTTCTTATT CCCACAGTGTATCGGCTAGCCTATCTCCGGCTAAATACACTT TGTGAACGCCTTCTGTCTGAGCACCCAGAATTAGA | 605 |
| | TCTAATTCTGGGTGCTCAGACAGAAGGCGTTCACAAAGTGTA TTTAGCCGGAGATAGGCTAGCCGATACACTGTGGGAATAAG AAAAATTAGTCATTTTTACTGTTCATTTTGAATTACAA | 606 |
| | GTATCGGCTAGCCTATC | 607 |
| | GATAGGCTAGCCGATAC | 608 |
| Retinoblastoma Arg661Trp CGG to TGG | AATGAACAGTAAAAATGACTAATTTTTCTTATTCCCACAGTGTA TCGGCTAGCCTATCTCCGGCTAAATACACTTTGTGAACGCCT TCTGTCTGAGCACCCAGAATTAGAACATATCATCT | 609 |
| | AGATGATATGTTCTAATTCTGGGTGCTCAGACAGAAGGCGTT CACAAAGTGTATTTAGCCGGAGATAGGCTAGCCGATACACTG TGGGAATAAGAAAAATTAGTCATTTTTACTGTTCATT | 610 |
| | CCTATCTCCGGCTAAAT | 611 |
| | ATTTAGCCGGAGATAGG | 612 |
| Retinoblastoma Leu662Pro CTA to CCA | AACAGTAAAAATGACTAATTTTTCTTATTCCCACAGTGTATCG GCTAGCCTATCTCCGGCTAAATACACTTTGTGAACGCCTTCT GTCTGAGCACCCAGAATTAGAACATATCATCTGGAC | 613 |
| | GTCCAGATGATATGTTCTAATTCTGGGTGCTCAGACAGAAGG CGTTCACAAAGTGTATTTAGCCGGAGATAGGCTAGCCGATAC ACTGTGGGAATAAGAAAAATTAGTCATTTTTACTGTT | 614 |
| | TCTCCGGCTAAATACAC | 615 |
| | GTGTATTTAGCCGGAGA | 616 |
| Retinoblastoma Glu675Term GAA to TAA | TATCGGCTAGCCTATCTCCGGCTAAATACACTTTGTGAACGC CTTCTGTCTGAGCACCCAGAATTAGAACATATCATCTGGACC CTTTTCCAGCACACCCTGCAGAATGAGTATGAACTCA | 617 |
| | TGAGTTCATACTCATTCTGCAGGGTGTGCTGGAAAAGGGTCC AGATGATATGTTCTAATTCTGGGTGCTCAGACAGAAGGCGTT CACAAAGTGTATTTAGCCGGAGATAGGCTAGCCGATA | 618 |
| | AGCACCCAGAATTAGAA | 619 |
| | TTCTAATTCTGGGTGCT | 620 |
| Retinoblastoma Gln685Pro CAG to CCG | TTTGTGAACGCCTTCTGTCTGAGCACCCAGAATTAGAACATA TCATCTGGACCCTTTTCCAGCACACCCTGCAGAATGAGTATG AACTCATGAGAGACAGGCATTTGGACCAAGTAAAAA | 621 |
| | TTTCTTACTTGGTCCAAATGCCTGTCTCTCATGAGTTCATACT CATTCTGCAGGGTGTGCTGGAAAAGGGTCCAGATGATATGTT CTAATTCTGGGTGCTCAGACAGAAGGCGTTCACAAA | 622 |

TABLE 13-continued pRB Mutations and Genome-Correcting Oligos

| Clinical Phenotype Mutation | Correcting Oligos | SEQ ID NO: |
|---|---|---|
| | CCTTTTCCAGCACACCC | 623 |
| | GGGTGTGCTGGAAAAGG | 624 |
| Retinoblastoma Cys706Tyr TGT to TAT | AAAACCATGTAATAAAATTCTGACTACTTTTACATCAATTTATT TACTAGATTATGATGTGTTCCATGTATGGCATATGCAAAGTGA AGAATATAGACCTTAAATTCAAAATCATTGTAAC | 625 |
| | GTTACAATGATTTTGAATTTAAGGTCTATATTCTTCACTTTGCA TATGCCATACATGGAACACATCATAATCTAGTAAATAAATTGA TGTAAAAGTAGTCAGAATTTTATTACATGGTTTT | 626 |
| | TATGATGTGTTCCATGT | 627 |
| | ACATGGAACACATCATA | 628 |
| Retinoblastoma Cys712Arg TGC to CGC | TTCTGACTACTTTTACATCAATTTATTTACTAGATTATGATGTG TTCCATGTATGGCATATGCAAAGTGAAGAATATAGACCTTAAA TTCAAAATCATTGTAACAGCATACAAGGATCTTC | 629 |
| | GAAGATCCTTGTATGCTGTTACAATGATTTTGAATTTAAGGTC TATATTCTTCACTTTGCATATGCCATACATGGAACACATCATA ATCTAGTAAATAAATTGATGTAAAAGTAGTCAGAA | 630 |
| | ATGGCATATGCAAAGTG | 631 |
| | CACTTTGCATATGCCAT | 632 |
| Retinoblastoma Tyr728Term TAC to TAA | GTATGGCATATGCAAAGTGAAGAATATAGACCTTAAATTCAAA ATCATTGTAACAGCATACAAGGATCTTCCTCATGCTGTTCAG GAGGTAGGTAATTTTCCATAGTAAGTTTTTTTGATA | 633 |
| | TATCAAAAAAACTTACTATGGAAAATTACCTACCTCCTGAACA GGATGAGGAAGATCCTTGTATGCTGTTACAATGATTTTGAATT TAAGGTCTATATTCTTCACTTTGCATATGCCATAC | 634 |
| | ACAGCATACAAGGATCT | 635 |
| | AGATGCTTGTATGCTGT | 636 |
| Retinoblastoma Glu748Term GAG to TAG | TTTTTTTTTTTTTTTACTGTTGTTCCTCAGACATTCAAACGTGT TTTGATCAAAGAAGAGGAGTATGATTCTATTATAGTATTCTATA ACTCGGTCTTCATGCAGAGACTGAAAACAAATA | 637 |
| | TATTTGTTTTCAGTCTCTGCATGAAGACCGAGTTATAGAATAC TATAATAGAATCATACTCCTCTTCTTTGATCAAAACACGTTTGA ATGTCTGAGGAAGAACAGTAAAAAAAAAAAAAAA | 638 |
| | AAGAAGAGGAGTATGAT | 639 |
| | ATCATACTCCTCTTCTT | 640 |
| Retinoblastoma Gln762Term CAG to TAG | GTTTTGATCAAAGAAGAGGAGTATGATTCTATTATAGTATTCT ATAACTCGGTCTTCATGCAGAGACTGAAAACAAATATTTTGCA GTATGCTTCCACCAGGGTAGGTGAAAAGTATCCTT | 641 |
| | AAGGATACTTTTGACCTACCCTGGTGGAAGCATACTGCAAAA TATTTGTTTTCAGTCTCTGCATGAAGACCGAGTTATAGAATAC TATAATAGAATCATACTCCTCTTCTTTGATCAAAAC | 642 |
| | TCTTCATGCAGAGACTG | 643 |
| | CAGTCTCTGCATGAAGA | 644 |
| Retinoblastoma Arg787Term CGA-TGA | TAATCTACTTTTTTGTTTTGCTCTAGCCCCCTACCTTGTCAC CAATACCTCACATTCCTCGAAGCCCTTACAAGTTTCCTAGTTC ACCCTTACGGATTCCTGGAGGGAACATCTATATTT | 645 |
| | AAATATAGATGTTCCCTCCAGGAATCCGTAAGGGTGAACTAG GAACTTGTAAGGGGCTTCGAGGAATGTGAGGTATTGGTGACA AGGTAGGGGGCTAGAGCAAAAACAAAAAAGTAGATTA | 646 |

TABLE 13-continued pRB Mutations and Genome-Correcting Oligos

| Clinical Phenotype Mutation | Correcting Oligos | SEQ ID NO: |
|---|---|---|
| | ACATTCCTCGAAGCCCT | 647 |
| | AGGGCTTCGAGGAATGT | 648 |
| Retinoblastoma Ser816Term TCA to TGA | CCTTACGGATTCCTGGAGGGAACATCTATATTTCACCCCTGA AGAGTCCATATAAAATTTCAGAAGGTCTGCCAACACCAACAA AAATGACTCCAAGATCAAGGTGTGTGTTTTCTCTTTA | 649 |
| | TAAAGAGAAAACACACACCTTGATCTTGGAGTCATTTTTGTTG GTGTTGGCAGACCTTCTGAAATTTTATATGGACTCTTCAGGG GTGAAATATAGATGTTCCCTCCAGGAATCCGTAAGG | 650 |
| | TAAAATTTCAGAAGGTC | 651 |
| | GACCTTCTGAAATTTTA | 652 |

EXAMPLE 8

BRCA1 and BRCA2

Breast cancer is the second major cause of cancer death in American women, with an estimated 44,190 lives lost (290 men and 43,900 women) in the US in 1997. While ovarian cancer accounts for fewer deaths than breast cancer, it still represents 4% of all female cancers. In 1994, two breast cancer susceptibility genes were identified: BRCA1 on chromosome 17 and BRCA2 on chromosome 13. When a woman carries a mutation in either BRCA1 or BRCA2, she is at increased risk of being diagnosed with breast or ovarian cancer at some point in her life.

Ford et al., *Am. J. Hum. Genet* 62: 676-689 (1998) assessed the contribution of BRCA1 and BRCA2 to inherited breast cancer by linkage and mutation analysis in 237 families, each with at least 4 cases of breast cancer. Families were included without regard to the occurrence of ovarian or other cancers. Overall, disease was linked to BRCA1 in an estimated 52% of families, to BRCA2 in 32% of families, and to neither gene in 16%, suggesting other predisposition genes. The majority (81%) of the breast-ovarian cancer families were due to BRCA1, with most others (14%) due to BRCA2. Conversely, the majority (76%) of families with both male and female breast cancer were due to BRCA2. The largest proportion (67%) of families due to other genes were families with 4 or 5 cases of female breast cancer only.

More than 75% of the reported mutations in the BRCA1 gene result in truncated proteins. Couch et al., *Hum. Mutat.* 8: 8-18, 1996. (1996) reported a total of 254 BRCA1 mutations, 132 (52%) of which were unique. A total of 221 (87%) of all mutations or 107 (81%) of the unique mutations are small deletions, insertions, nonsense point mutations, splice variants, and regulatory mutations that result in truncation or absence of the BRCA1 protein. A total of 11 disease-associated missense mutations (5 unique) and 21 variants (19 unique) as yet unclassified as missense mutations or polymorphisms had been detected. Thirty-five independent benign polymorphisms had been described. The most common mutations were 185delAG and 5382insC, which accounted for 30 (11.7%) and 26 (10.1%), respectively, of all the mutations.

Most BRCA2 mutations are predicted to result in a truncated protein product. The smallest known cancer-associated deletion removes from the C terminus only 224 of the 3,418 residues constituting BRCA2, suggesting that these terminal amino acids are critical for BRCA2 function. Studies (Spain et al., Proc. Natl. Acad. Sci. 96:13920-13925 (1999)) suggest that such truncations eliminate or interfere with 2 nuclear localization signals that reside within the final 156 residues of BRCA2, suggesting that the vast majority of BRCA2 mutants are nonfunctional because they are not translocated into the nucleus.

The attached table discloses the correcting oligonucleotide base sequences for the BRACA1 and BRACA2 oligonucleotides of the invention.

TABLE 14

BRCA1 Mutations and Genome-Correcting Oligos

| Clinical Phenotype & Mutation | Correcting Oligos | SEQ ID NO: | |
|---|---|---|---|
| Breast Cancer Met-1-Ile ATG to ATT | CTGCGCTCAGGAGGCCTTCACCCTCTGCTCTGGGTAAAGTT CATTGGAACAGAAAGAAATGGATTTATCTGCTCTTCGCGTTG AAGAAGTACAAAATGTCATTAATGCTATGCAGAAAATC | 653 | 653 |
| | GATTTTCTGCATAGCATTAATGACATTTTGTACTTCTTCAACG CGAAGAGCAGATAAATCCATTTCTTTCTGTTCCAATGAACTTT ACCCAGAGCAGAGGGTGAAGGCCTCCTGAGCGCAG | 654 | |

TABLE 14-continued

BRCA1 Mutations and Genome-Correcting Oligos

| Clinical Phenotype & Mutation | Correcting Oligos | SEQ ID NO: |
|---|---|---|
| | AAAGAAATGGATTTATC | 655 |
| | GATAAATCCATTTCTTT | 656 |
| Breast Cancer Val-11-Ala GTA to GCA | CTGGGTAAAGTTCATTGGAACAGAAAGAAATGGATTTATCTG CTCTTCGCGTTGAAGAAGTACAAAATGTCATTAATGCTATGCA GAAAATCTTAGAGTGTCCCATCTGTCTGGAGTTGAT | 657 |
| | ATCAACTCCAGACAGATGGGACACTCTAAGATTTTCTGCATA GCATTAATGACATTTTGTACTTCTTCAACGCGAAGAGCAGATA AATCCATTTCTTTCTGTTCCAATGAACTTTACCCAG | 658 |
| | TGAAGAAGTACAAAATG | 659 |
| | CATTTTGTACTTCTTCA | 660 |
| Breast Cancer Ile-21-Val ATC to GTC | ATGGATTTATCTCTCTTCGCGTTGAAGAAGTACAAAATGTCA TTAATGCTATGCAGAAAATCTTAGAGTGTCCCATCTGTCTGG AGTTGATCAAGGAACCTGTCTCCACAAAGTGTGACC | 661 |
| | GGTCACACTTTGTGGAGACAGGTTCCTTGATCAACTCCAGAC AGATGGGACACTCTAAGATTTTCTGCATAGCATTAATGACATT TTGTACTTCTTCAACGCGAAGAGCAGATAAATCCAT | 662 |
| | TGCAGAAAATCTTAGAG | 663 |
| | CTCTAAGATTTTCTGCA | 664 |
| Breast Cancer Leu-22-Ser TTA to TCA | ATTTATCTGCTCTTCGCGTTGAAGAAGTACAAAATGTCATTAA TGCTATGCAGAAAATCTTAGAGTGTCCCATCTGTCTGGAGTT GATCAAGGAACCTGTCTCCACAAAGTGTGACCACAT | 665 |
| | ATGTGGTCACACTTTGTGGAGACAGGTTCCTTGATCAACTCC AGACAGATGGGACACTCTAAGATTTTCTGCATAGCATTAATG ACATTTTGTACTTCTTCAACGCGAAGAGCAGATAAAT | 666 |
| | GAAAATCTTAGAGTGTC | 667 |
| | GACACTCTAAGATTTTC | 668 |
| Breast Cancer Cys-39-Tyr TGT to TAT | AGAAAATCTTAGAGTGTCCCATCTGTCTGGAGTTGATCAAGG AACCTGTCTCCACAAAGTGTGACCACATATTTTGCAAATTTTG CATGCTGAAACTTCTCAACCAGAAGAAAGGGCCTTC | 669 |
| | GAAGGCCCTTTCTTCTGGTTGAGAAGTTTCAGCATGCAAAAT TTGCAAAATATGTGGTCACACTTTGTGGAGACAGGTTCCTTG ATCAACTCCAGACAGATGGGACACTCTAAGATTTTCT | 670 |
| | CACAAAGTGTGACCACA | 671 |
| | TGTGGTCACACTTTGTG | 672 |
| Breast Cancer Cys-61-Gly TGT to GGT | CACATATTTTGCAAATTTTGCATGCTGAAACTTCTCAACCAGA AGAAAGGGCCTTCACAGTGTCCTTTATGTAAGAATGATATAAC CAAAAGGAGCCTACAAGAAAGTACGAGATTTAGTC | 673 |
| | GACTAAATCTCGTACTTTCTTGTAGGCTCCTTTTGGTTATATC ATTCTTACATAAAGGACACTGTGAAGGCCCTTTCTTCTGGTT GAGAAGTTTCAGCATGCAAAATTTGCAAAATATGTG | 674 |
| | CTTCACAGTGTCCTTTA | 675 |
| | TAAAGGACACTGTGAAG | 676 |
| Breast Cancer Leu-63-Stop TTA to TAA | TTTGCAAATTTTGCATGCTGAAACTTCTCAACCAGAAGAAAGG GCCTTCACAGTGTCCTTTATGTAAGAATGATATAACCAAAAGG AGCCTACAAGAAAGTACGAGATTTAGTCAACTTGT | 677 |
| | ACAAGTTGACTAAATCTCGTACTTTCTTGTAGGCTCCTTTTGG TTATATCATTCTTACATAAAGGACACTGTGAAGGCCCTTTCTT CTGGTTGAGAAGTTTCAGCATGCAAAATTTGCAAA | 678 |

TABLE 14-continued

BRCA1 Mutations and Genome-Correcting Oligos

| Clinical Phenotype & Mutation | Correcting Oligos | SEQ ID NO: |
|---|---|---|
| | GTGTCCTTTATGTAAGA | 679 |
| | TCTTACATAAAGGACAC | 680 |
| Breast Cancer Cys-64-Arg TGT to CGT | TGCAAATTTTGCATGCTGAAACTTCTCAACCAGAAGAAAGGG CCTTCACAGTGTCCTTTATGTAAGAATGATATAACCAAAAGGA GCCTACAAGAAAGTACGAGATTTAGTCAACTTGTTG | 681 |
| Breast Cancer Cys-64-Gly TGT to GGT | CAACAAGTTGACTAAATCTCGTACTTTCTTGTAGGCTCCTTTT GGTTATATCATTCTTACATAAAGGACACTGTGAAGGCCCTTTC TTCTGGTTGAGAAGTTTCAGCATGCAAAATTTGCA | 682 |
| | GTCCTTTATGTAAGAAT | 683 |
| | ATTCTTACATAAAGGAC | 684 |
| Breast Cancer Cys-64-Tyr TGT to TAT | GCAAATTTTGCATGCTGAAACTTCTCAACCAGAAGAAAGGGC CTTCACAGTGTCCTTTATGTAAGAATGATATAACCAAAAGGAG CCTACAAGAAAGTACGAGATTTAGTCAACTTGTTGA | 685 |
| | TCAACAAGTTGACTAAATCTCGTACTTTCTTGTAGGCTCCTTT TGGTTATATCATTCTTACATAAAGGACACTGTGAAGGCCCTTT CTTCTGGTTGAGAAGTTTCAGCATGCAAAATTTGC | 686 |
| | TCCTTTATGTAAGAATG | 687 |
| | CATTCTTACATAAAGGA | 688 |
| Breast Cancer Gln-74-Stop CAA to TAA | CAGAAGAAAGGGCCTTCACAGTGTCCTTTATGTAAGAATGAT ATAACCAAAAGGAGCCTACAAGAAAGTACGAGATTTAGTCAA CTTGTTGAAGAGCTATTGAAAATCATTTGTGCTTTTC | 689 |
| | GAAAAGCACAAATGATTTTCAATAGCTCTTCAACAAGTTGACT AAATCTCGTACTTTCTTGTAGGCTCCTTTTGGTTATATCATTCT TACATAAAGGACACTGTGAAGGCCCTTTCTTCTG | 690 |
| | GGAGCCTACAAGAAAGT | 691 |
| | ACTTTCTTGTAGGCTCC | 692 |
| Breast Cancer Tyr-105-Cys TAT to TGT | AGCTATTGAAAATCATTTGTGCTTTTCAGCTTGACACAGGTTT GGAGTATGCAAACAGCTATAATTTTGCAAAAAAGGAAAATAAC TCTCCTGAACATCTAAAAGATGAAGTTTCTATCAT | 693 |
| | ATGATAGAAACTTCATCTTTTAGATGTTCAGGAGAGTTATTTT CCTTTTTTGCAAAATTATAGCTGTTTGCATACTCCAAACCTGT GTCAAGCTGAAAAGCACAAATGATTTTCAATAGCT | 694 |
| | AAACAGCTATAATTTTG | 695 |
| | CAAAATTATAGCTGTTT | 696 |
| Breast Cancer Asn-158-Tyr AAC to TAC | CTACAGAGTGAACCCGAAAATCCTTCCTTGCAGGAAACCAGT CTCAGTGTCCAACTCTCTAACCTTGGAACTGTGAGAACTCTG AGGACAAAGCAGCGGATACAACCTCAAAAGACGTCTG | 697 |
| | CAGACGTCTTTTGAGGTTGTATCCGCTGCTTTGTCCTCAGAG TTCTCACAGTTCCAAGGTTAGAGAGTTGGACACTGAGACTGG TTTCCTGCAAGGAAGGATTTTCGGGTTCACTCTGTAG | 698 |
| | AACTCTCTAACCTTGGA | 699 |
| | TCCAAGGTTAGAGAGTT | 700 |
| Breast Cancer Gln-169-Stop CAG to TAG | GAAACCAGTCTCAGTGTCCAACTCTCTAACCTTGGAACTGTG AGAACTCTGAGGACAAAGCAGCGGATACAACCTCAAAAGAC GTCTGTCTACATTGAATTGGGATCTGATTCTTCTGAAG | 701 |
| | CTTCAGAAGAATCAGATCCCAATTCAATGTAGACAGACGTCTT TTGAGGTTGTATCCGCTGCTTTGTCCTCAGAGTTCTCACAGT TCCAAGGTTAGAGAGTTGGACACTGAGACTGGTTTC | 702 |

TABLE 14-continued

BRCA1 Mutations and Genome-Correcting Oligos

| Clinical Phenotype & Mutation | Correcting Oligos | SEQ ID NO: |
|---|---|---|
| | GGACAAAGCAGCGGATA | 703 |
| | TATCCGCTGCTTTGTCC | 704 |
| Breast Cancer Trp-353-Stop TGG to TAG | CTCCCAGCACAGAAAAAAAGGTAGATCTGAATGCTGATCCCC TGTGTGAGAGAAAAGAATGGAATAAGCAGAAACTGCCATGCT CAGAGAATCCTAGAGATACTGAAGATGTTCCTTGGAT | 705 |
| | ATCCAAGGAACATCTTCAGTATCTCTAGGATTCTCTGAGCAT GGCAGTTTCTGCTTATTCCATTCTTTTCTCTCACACAGGGGAT CAGCATTCAGATCTACCTTTTTTTCTGTGCTGGGAG | 706 |
| | AAAAGAATGGAATAAGC | 707 |
| | GCTTATTCCATTCTTTT | 708 |
| Breast Cancer Ile-379-Met ATT to ATG | ATGCTCAGAGAATCCTAGAGATACTGAAGATGTTCCTTGGAT AACACTAAATAGCAGCATTCAGAAAGTAATGAGTGGTTTTCC AGAAGTGATGAACTGTTAGGTTCTGATGACTCACAT | 709 |
| | ATGTGAGTCATCAGAACCTAACAGTTCATCACTTCTGGAAAAC CACTCATTAACTTTCTGAATGCTGCTATTTAGTGTTATCCAAG GAACATCTTCAGTATCTCTAGGATTCTCTGAGCAT | 710 |
| | AGCAGCATTCAGAAAGT | 711 |
| | ACTTTCTGAATGCTGCT | 712 |
| Breast Cancer Glu-421-Gly GAA to GGA | GGGAGTCTGAATCAAATGCCAAAGTAGCTGATGTATTGGACG TTCTAAATGAGGTAGATGAATATTCTGGTTCTTCAGAGAAAAT AGACTTACTGGCCAGTGATCCTCATGAGGCTTTAAT | 713 |
| | ATTAAAGCCTCATGAGGATCACTGGCCAGTAAGTCTATTTTCT CTGAAGAACCAGAATATTCATCTACCTCATTTAGAACGTCCAA TACATCAGCTACTTTGGCATTTGATTCAGACTCCC | 714 |
| | GGTAGATGAATATTCTG | 715 |
| | CAGAATATTCATCTACC | 716 |
| Breast Cancer Phe-461-Leu TTT to CTT | ATATGTAAAAGTGAAAGAGTTCACTCCAAATCAGTAGAGAGTA ATATTGAAGACAAAATATTTGGGAAAACCTATCGGAAGAAGG CAAGCCTCCCCAACTTAAGCCATGTAACTGAAAATC | 717 |
| | GATTTTCAGTTACATGGCTTAAGTTGGGGAGGCTTGCCTTCT TCCGATAGGTTTTCCCAAATATTTTGTCTTCAATATTACTCTCT ACTGATTTGGAGTGAACTCTTTCACTTTTACATAT | 718 |
| | ACAAAATATTTGGGAAA | 719 |
| | TTTCCCAAATATTTTGT | 720 |
| Breast Cancer Tyr-465-Leu TAT to GAT | GAAAGAGTTCACTCCAAATCAGTAGAGAGTAATATTGAAGAC AAAATATTTGGGAAAACCTATCGGAAGAAGGCAAGCCTCCCC AACTTAAGCCATGTAACTGAAAATCTAATTATAGGAG | 721 |
| | CTCCTATAATTAGATTTTCAGTTACATGGCTTAAGTTGGGGAG GCTTGCCTTCTTCCGATAGGTTTTCCCAAATATTTTGTCTTCA ATATTACTCTCTACTGATTTGGAGTGAACTCTTTC | 722 |
| | GGAAAACCTATCGGAAG | 723 |
| | CTTCCGATAGGTTTTCC | 724 |
| Breast Cancer Gly-484-Stop GGA to TGA | ACCTATCGGAAGAAGGCAAGCCTCCCCAACTTAAGCCATGTA ACTGAAAATCTAATTATAGGAGCATTTGTTACTGAGCCACAGA TAATACAAGAGCGTCCCCTCACAAATAAATTAAAGC | 725 |
| | GCTTTAATTTATTTGTGAGGGGACGCTCTTGTATTATCTGTGG CTCAGTAACAAATGCTCCTATAATTAGATTTTCAGTTACATGG CTTAAGTTGGGGAGGCTTGCCTTCTTCCGATAGGT | 726 |

TABLE 14-continued

BRCA1 Mutations and Genome-Correcting Oligos

| Clinical Phenotype & Mutation | Correcting Oligos | SEQ ID NO: |
|---|---|---|
| | TAATTATAGGAGCATTT | 727 |
| | AAATGCTCCTATAATTA | 728 |
| Breast Cancer Arg-507-Ile AGA to ATA | TTACTGAGCCACAGATAATACAAGAGCGTCCCCTCACAAATA AATTAAAGCGTAAAAGGAGACCTACATCAGGCCTTCATCCTG AGGATTTTATCAAGAAAGCAGATTTGGCAGTTCAAAA | 729 |
| | TTTTGAACTGCCAAATCTGCTTTCTTGATAAAATCCTCAGGAT GAAGGCCTGATGTAGGTCTCCTTTTACGCTTTAATTTATTTGT GAGGGGACGCTCTTGTATTATCTGTGGCTCAGTAA | 730 |
| | TAAAAGGAGACCTACAT | 731 |
| | ATGTAGGTCTCCTTTTA | 732 |
| Breast Cancer Ser-510-Stop TCA to TGA | CACAGATAATACAAGAGCGTCCCCTCACAAATAAATTAAAGC GTAAAAGGAGACCTACATCAGGCCTTCATCCTGAGGATTTTA TCAAGAAAGCAGATTTGGCAGTTCAAAAGACTCCTGA | 733 Q |
| | TCAGGAGTCTTTTGAACTGCCAAATCTGCTTTCTTGATAAAT CCTCAGGATGAAGGCCTGATGTAGGTCTCCTTTTACGCTTTA ATTTATTTGTGAGGGGACGCTCTTGTATTATCTGTG | 734 |
| | ACCTACATCAGGCCTTC | 735 |
| | GAAGGCCTGATGTAGGT | 736 |
| Breast Cancer Gln-526-Stop CAA to TAA | AGGAGACCTACATCAGGCCTTCATCCTGAGGATTTTATCAAG AAAGCAGATTTGGCAGTTCAAAAGACTCCTGAAATGATAAATC AGGGAACTAACCAAACGGAGCAGAATGGTCAAGTGA | 737 |
| | TCACTTGACCATTCTGCTCCGTTTGGTTAGTTCCCTGATTTAT CATTTCAGGAGTCTTTTGAACTGCCAAATCTGCTTTCTTGATA AAATCCTCAGGATGAAGGCCTGATGTAGGTCTCCT | 738 |
| | TGGCAGTTCAAAAGACT | 739 |
| | AGTCTTTTGAACTGCCA | 740 |
| Breast Cancer Gln-541-Stop CAG to TAG | AGGAGACCTACATCAGGCCTTCATCCTGAGGATTTTATCAAG AAAGCAGATTTGGCAGTTCAAAAGACTCCTGAAATGATAAATC AGGGAACTAACCAAACGGAGCAGAATGGTCAAGTGA | 741 |
| | TCACTTGACCATTCTGCTCCGTTTGGTTAGTTCCCTGATTTAT CATTTCAGGAGTCTTTTGAACTGCCAAATCTGCTTTCTTGATA AAATCCTCAGGATGAAGGCCTGATGTAGGTCTCCT | 742 |
| | AAACGGAGCAGAATGGT | 743 |
| | ACCATTCTGCTCCGTTT | 744 |
| Breast Cancer Gly-552-Val GGT to GTT | TAAATCAGGGAACTAACCAAACGGAGCAGAATGGTCAAGTGA TGAATATTACTAATAGTGGTCATGAGAATAAAACAAAAGGTGA TTCTATTCAGAATGAGAAAAATCCTAACCCAATAGA | 745 |
| | TCTATTGGGTTAGGATTTTTCTCATTCTGAATAGAATCACCTTT TGTTTTATTCTCATGACCACTATTAGTAATATTCATCACTTGAC CATTCTGCTCCGTTTGGTTAGTTCCCTGATTTA | 746 |
| | TAATAGTGGTCATGAGA | 747 |
| | TCTCATGACCACTATTA | 748 |
| Breast Cancer Gln-563-Stop CAT to TAG | GGTCAAGTGATGAATATTACTAATAGTGGTCATGAGAATAAAA CAAAAGGTGATTCTATTCAGAATGAGAAAAATCCTAACCCAAT AGAATCACTCGAAAAGAATCTGCTTTCAAAACGA | 749 |
| | TCGTTTTGAAAGCAGATTCTTTTTCGAGTGATTCTATTGGGTT AGGATTTTTCTCATTCTGAATAGAATCACCTTTTGTTTTATTCT CATGACCACTATTAGTAATATTCATCACTTGACC | 750 |

TABLE 14-continued

BRCA1 Mutations and Genome-Correcting Oligos

| Clinical Phenotype & Mutation | Correcting Oligos | SEQ ID NO: |
|---|---|---|
| | ATTCTATTCAGAATGAG | 751 |
| | CTCATTCTGAATAGAAT | 752 |
| Ovarian Cancer Lys-607-Stop AAA to TAA | ATAAGCAGCAGTATAAGCAATATGGAACTCGAATTAAATATCC ACAATTCAAAAGCACCTAAAAAGAATAGGCTGAGGAGGAAGT CTTCTACCAGGCATATTCATGCGCTTGAACTAGTAG | 753 |
| | CTACTAGTTCAAGCGCATGAATATGCCTGGTAGAAGACTTCC TCCTCAGCCTATTCTTTTTAGGTGCTTTTGAATTGTGGATATT TAATTCGAGTTCCATATTGCTTATACTGCTGCTTAT | 754 |
| | AAGCACCTAAAAAGAAT | 755 |
| | ATTCTTTTTAGGTGCTT | 756 |
| Breast Cancer Leu-639-Stop TTG to TAG | ATATTCATGCGCTTGAACTAGTAGTCAGTAGAAATCTAAGCCC ACCTAATTGTACTGAATTGCAAATTGATAGTTGTTCTAGCAGT GAAGAGATAAAGAAAAAAAGTACAACCAAATGCC | 757 |
| | GGCATTTGGTTGTACTTTTTTTTCTTTATCTCTTCACTGCTAGA ACAACTATCAATTTGCAATTCAGTACAATTAGGTGGGCTTAGA TTTCTACTGACTACTAGTTCAAGCGCATGAATAT | 758 |
| | TACTGAATTGCAAATTG | 759 |
| | CAATTTGCAATTCAGTA | 760 |
| Breast Cancer Asp-693-Asn GAC to AAC | GAACCTGCAACTGGAGCCAAGAAGAGTAACAAGCCAAATGAA CAGACAAGTAAAAGACATGACAGCGATACTTTCCCAGAGCTG AAGTTAACAAATGCACCTGGTTCTTTTACTAAGTGTT | 761 |
| | AACACTTAGTAAAAGAACCAGGTGCATTTGTTAACTTCAGCTC TGGGAAAGTATCGCTGTCATGTCTTTTACTTGTCTGTTCATTT GGCTTGTTACTCTTCTTGGCTCCAGTTGCAGGTTC | 762 |
| | AAAGACATGACAGCGAT | 763 |
| | ATCGCTGTCATGTCTTT | 764 |
| Ovarian Cancer Glu-720-Stop GAA to TAA | CTGAAGTTAACAAATGCACCTGGTTCTTTTACTAAGTGTTCAA ATACCAGTGAACTTAAAGAATTTGTCAATCCTAGCCTTCCAAG AGAAGAAAAAGAAGAGAAACTAGAAACAGTTAAAG | 765 |
| | CTTTAACTGTTTCTAGTTTCTCTTCTTTTTCTTCTCTTGGAAGG CTAGGATTGACAAATTCTTTAAGTTCACTGGTATTTGAACACT TAGTAAAAGAACCAGGTGCATTTGTTAACTTCAG | 766 |
| | AACTTAAAGAATTTGTC | 767 |
| | GACAAATTCTTTAAGTT | 768 |
| Breast Cancer Glu-755-Stop GAA to TAA | CTAGAAACAGTTAAAGTGTCTAATAATGCTGAAGACCCCAAA GATCTCATGTTAAGTGGAGAAAGGGTTTTGCAAACTGAAAGA TCTGTAGAGAGTAGCAGTATTTCATTGGTACCTGGTA | 769 |
| | TACCAGGTACCAATGAAATACTGCTACTCTCTACAGATCTTTC AGTTTGCAAAACCCTTTCTCCACTTAACATGAGATCTTTGGGG TCTTCAGCATTATTAGACACTTTAACTGTTTCTAG | 770 |
| | TAAGTGGAGAAAGGGTT | 771 |
| | AACCCTTTCTCCACTTA | 772 |
| Breast Cancer Ser-770-Stop TCA to TAA | TCATGTTAAGTGGAGAAAGGGTTTTGCAAACTGAAAGATCTG TAGAGAGTAGCAGTATTTCATTGGTACCTGGTACTGATTATG GCACTCAGGAAAGTATCTCGTTACTGGAAGTTAGCAC | 773 |
| | GTGCTAACTTCCAGTAACGAGATACTTTCCTGAGTGCCATAA TCAGTACCAGGTACCAATGAAATACTGCTACTCTCTACAGAT CTTTCAGTTTGCAAAACCCTTTCTCCACTTAACATGA | 774 |

TABLE 14-continued

BRCA1 Mutations and Genome-Correcting Oligos

| Clinical Phenotype & Mutation | Correcting Oligos | SEQ ID NO: |
|---|---|---|
| | CAGTATTTCATTGGTAC | 775 |
| | GTACCAATGAAATACTG | 776 |
| Breast Cancer Val-772-Ala GTA to GCA | TAAGTGGAGAAAGGGTTTTGCAAACTGAAAGATCTGTAGAGA GTAGCAGTATTTCATTGGTACCTGGTACTGATTATGGCACTC AGGAAAGTATCTCGTTACTGGAAGTTAGCACTCTAGG | 777 |
| | CCTAGAGTGCTAACTTCCAGTAACGAGATACTTTCCTGAGTG CCATAATCAGTACCAGGTACCAATGAAATACTGCTACTCTCTA CAGATCTTTCAGTTTGCAAAACCCTTTCTCCACTTA | 778 |
| | TTCATTGGTACCTGGTA | 779 |
| | TACCAGGTACCAATGAA | 780 |
| Breast Cancer Gln-780-Stop CAG to TAG | ACTGAAAGATCTGTAGAGAGTAGCAGTATTTCATTGGTACCT GGTACTGATTATGGCACTCAGGAAAGTATCTCGTTACTGGAA GTTAGCACTCTAGGGAAGGCAAAAACAGAACCAAATA | 781 |
| | TATTTGGTTCTGTTTTTGCCTTCCCTAGAGTGCTAACTTCCAG TAACGAGATACTTTCCTGAGTGCCATAATCAGTACCAGGTAC CAATGAAATACTGCTACTCTACAGATCTTTCAGT | 782 |
| | ATGGCACTCAGGAAAGT | 783 |
| | ACTTTCCTGAGTGCCAT | 784 |
| Breast Cancer Glu-797-Stop GAA to TAA | TATGGCACTCAGGAAAGTATCTCGTTACTGGAAGTTAGCACT CTAGGGAAGGCAAAAACAGAACCAAATAAATGTGTGAGTCAG TGTGCAGCATTTGAAAACCCCAAGGGACTAATTCATG | 785 |
| | CATGAATTAGTCCCTTGGGGTTTTCAAATGCTGCACACTGAC TCACACATTTATTTGGTTCTGTTTTTGCCTTCCCTAGAGTGCT AACTTCCAGTAACGAGATACTTTCCTGAGTGCCATA | 786 |
| | CAAAAACAGAACCAAAT | 787 |
| | ATTTGGTTCTGTTTTTG | 788 |
| Breast Cancer Lys-820-Glu AAA to GAA | AAATGTGTGAGTCAGTGTGCAGCATTTGAAAACCCCAAGGGA CTAATTCATGGTTGTTCCAAAGATAATAGAAATGACACAGAAG GCTTTAAGTATCCATTGGGACATGAAGTTAACCACA | 789 |
| | TGTGGTTAACTTCATGTCCCAATGGATACTTAAAGCCTTCTGT GTCATTTCTATTATCTTTGGAACAACCATGAATTAGTCCCTTG GGGTTTTCAAATGCTGCACACTGACTCACACATTT | 790 |
| | GTTGTTCCAAAGATAAT | 791 |
| | ATTATCTTTGGAACAAC | 792 |
| Breast Cancer Thr-826-Lys ACA to AAA | CAGCATTTGAAAACCCCAAGGGACTAATTCATGGTTGTTCCA AAGATAATAGAAATGACACAGAAGGCTTTAAGTATCCATTGG GACATGAAGTTAACCACAGTCGGGAAACAAGCATAGA | 793 |
| | TCTATGCTTGTTTCCCGACTGTGGTTAACTTCATGTCCCAATG GATACTTAAAGCCTTCTGTGTCATTTCTATTATCTTTGGAACA ACCATGAATTAGTCCCTTGGGGTTTTCAAATGCTG | 794 |
| | AAATGACACAGAAGGCT | 795 |
| | AGCCTTCTGGTCATTT | 796 |
| Breast Cancer Arg-841-Trp CGG to TGG | GATAATAGAAATGACACAGAAGGCTTTAAGTATCCATTGGGA CATGAAGTTAACCACAGTTGGGAAACAAGCATAGAAATGGAA GAAAGTGAACTTGATGCTCAGTATTTGCAGAATACAT | 797 |
| | ATGTATTCTGCAAATACTGAGCATCAAGTTCACTTTCTTCCAT TTCTATGCTTGTTTCCCGACTGTGGTTAACTTCATGTCCCAAT GGATACTTAAAGCCTTCTGTGTCATTTCTATTATC | 798 |

TABLE 14-continued

BRCA1 Mutations and Genome-Correcting Oligos

| Clinical Phenotype & Mutation | Correcting Oligos | SEQ ID NO: |
|---|---|---|
| | ACCACAGTCGGGAAACA | 799 |
| | TGTTTCCCGACTGTGGT | 800 |
| Breast Cancer Pro-871-Leu CCG to CTG | AACTTGATGCTCAGTATTTGCAGAATACATTCAAGGTTTCAAA GCGCCAGTCATTTGCTCCGTTTTCAAATCCAGGAAATGCAGA AGAGGAATGTGCAACATTCTCTGCCCACTCTGGGTC | 801 |
| | GACCCAGAGTGGGCAGAGAATGTTGCACATTCCTCTTCTGCA TTTCCTGGATTTGAAAACGGAGCAAATGACTGGCGCTTTGAA ACCTTGAATGTATTCTGCAAATACTGAGCATCAAGTT | 802 |
| | ATTTGCTCCGTTTTCAA | 803 |
| | TTGAAAACGGAGCAAAT | 804 |
| Breast Cancer Leu-892-Ser TTA to TCA | TTTCAAATCCAGGAAATGCAGAAGAGGAATGTGCAACATTCT CTGCCCACTCTGGGTCCTTAAAGAAACAAAGTCCAAAAGTCA CTTTTGAATGTGAACAAAAGGAAGAAAATCAAGGAAA | |
| | TTTCCTTGATTTTCTTCCTTTTGTTCACATTCAAAAGTGACTTT TGGACTTTGTTTCTTTAAGGACCCAGAGTGGGCAGAGAATGT TGCACATTCCTCTTCTGCATTTCCTGGATTTGAAA | 806 |
| | TGGGTCCTTAAAGAAAC | 807 |
| | GTTTCTTTAAGGACCCA | 808 |
| Breast Cancer Glu-908-Stop GAA to TAA | CACTCTGGGTCCTTAAAGAAACAAAGTCCAAAAGTCACTTTTG AATGTGAACAAAAGGAAGAAAATCAAGGAAAGAATGAGTCTA ATATCAAGCCTGTACAGACAGTTAATATCACTGCAG | 809 |
| | CTGCAGTGATATTAACTGTCTGTACAGGCTTGATATTAGACTC ATTCTTTCCTTGATTTTCTTCCTTTTGTTCACATTCAAAAGTGA CTTTTGGACTTTGTTTCTTTAAGGACCCAGAGTG | 810 |
| | AAAAGGAAGAAAATCAA | 811 |
| | TTGATTTTCTTCCTTTT | 812 |
| Breast Cancer Gly-960-Asp GGC to GAC | ATAATGCCAAATGTAGTATCAAAGGAGGCTCTAGGTTTTGTCT ATCATCTCAGTTCAGAGGCAACGAAACTGGACTCATTACTCC AAATAAACATGGACTTTTACAAAACCCATATCGTAT | 813 |
| | ATACGATATGGGTTTTGTAAAAGTCCATGTTTATTTGGAGTAA TGAGTCCAGTTTCGTTGCCTCTGAACTGAGATGATAGACAAA ACCTAGAGCCTCCTTTGATACTACATTTGGCATTAT | 814 |
| | GTTCAGAGGCAACGAAA | 815 |
| | TTTCGTTGCCTCTGAAC | 816 |
| Breast Cancer Met-1008-Ile ATG to ATA | ATTTGTTAAAACTAAATGTAAGAAAAATCTGCTAGAGGAAAAC TTTGAGGAACATTCAATGTCACCTGAAAGAGAAATGGGAAAT GAGAACATTCCAAGTACAGTGAGCACAATTAGCCGT | 817 |
| | ACGGCTAATTGTGCTCACTGTACTTGGAATGTTCTCATTTCCC ATTTCTCTTTCAGGTGACATTGAATGTTCCTCAAAGTTTTCCT CTAGCAGATTTTTCTTACATTTAGTTTTAACAAAT | 818 |
| | CATTCAATGTCACCTGA | 819 |
| | TCAGGTGACATTGAATG | 820 |
| Breast Cancer Thr-1025-Ile ACA to ATA | ACTTTGAGGAACATTCAATGTCACCTGAAAGAGAAATGGGAA ATGAGAACATTCCAAGTACAGTGAGCACAATTAGCCGTAATA ACATTAGAGAAAATGTTTTTAAAGAAGCCAGCTCAAG | 821 |
| | CTTGAGCTGGCTTCTTTAAAAACATTTTCTCTAATGTTATTACG GCTAATTGTGCTCACTGTACTTGGAATGTTCTCATTTCCCATT TCTCTTTCAGGTGACATTGAATGTTCCTCAAAGT | 822 |

TABLE 14-continued

BRCA1 Mutations and Genome-Correcting Oligos

| Clinical Phenotype & Mutation | Correcting Oligos | SEQ ID NO: |
|---|---|---|
| | TCCAAGTACAGTGAGCA | 823 |
| | TGCTCACTGTACTTGGA | 824 |
| Breast Cancer Glu-1038-Gly GAA to GGA | ACATTCCAAGTACAGTGAGCACAATTAGCCGTAATAACATTAG AGAAAATGTTTTTAAAGAAGCCAGCTCAAGCAATATTAATGAA GTAGGTTCCAGTACTAATGAAGTGGGCTCCAGTAT | 825 |
| | ATACTGGAGCCCACTTCATTAGTACTGGAACCTACTTCATTAA TATTGCTTGAGCTGGCTTCTTTAAAAACATTTTCTCTAATGTTA TTACGGCTAATTGTGCTCACTGTACTTGGAATGT | 826 |
| | TTTTAAAGAAGCCAGCT | 827 |
| | AGCTGGCTTCTTTAAAA | 828 |
| Breast Cancer Ser-1040-Asn AGC to AAC | CAAGTACAGTGAGCACAATTAGCCGTAATAACATTAGAGAAA ATGTTTTTAAAGAAGCCAGCTCAAGCAATATTAATGAAGTAGG TTCCAGTACTAATGAAGTGGGCTCCAGTATTAATGA | 829 |
| | TCATTAATACTGGAGCCCACTTCATTAGTACTGGAACCTACTT CATTAATATTGCTTGAGCTGGCTTCTTTAAAAACATTTTCTCTA ATGTTATTACGGCTAATTGTGCTCACTGTACTTG | 830 |
| | AGAAGCCAGCTCAAGCA | 831 |
| | TGCTTGAGCTGGCTTCT | 832 |
| Breast Cancer Val-1047-Ala GTA to GCA | GCCGTAATAACATTAGAGAAAATGTTTTTAAAGAAGCCAGCTC AAGCAATATTAATGAAGTAGGTTCCAGTACTAATGAAGTGGG CTCCAGTATTAATGAAATAGGTTCCAGTGATGAAAA | 833 |
| | TTTTCATCACTGGAACCTATTTCATTAATACTGGAGCCCACTT CATTAGTACTGGAACCTACTTCATTAATATTGCTTGAGCTGGC TTCTTTAAAAACATTTTCTCTAATGTTATTACGGC | 834 |
| | TAATGAAGTAGGTTCCA | 835 |
| | TGGAACCTACTTCATTA | 836 |
| Breast Cancer Leu-1080-Stop TTG to TAG | AAATAGGTTCCAGTGATGAAAACATTCAAGCAGAACTAGGTA GAAACAGAGGGCCAAAATTGAATGCTATGCTTAGATTAGGGG TTTTGCAACCTGAGGTCTATAAACAAAGTCTTCCTGG | 837 |
| | CCAGGAAGACTTTGTTTATAGACCTCAGGTTGCAAAACCCCT AATCTAAGCATAGCATTCAATTTTGGCCCTCTGTTTCTACCTA GTTCTGCTTGAATGTTTTCATCACTGGAACCTATTT | 838 |
| | GCCAAAATTGAATGCTA | 839 |
| | TAGCATTCAATTTTGGC | 840 |
| Breast Cancer Leu-1086-Stop TTA to TGA | AAAACATTCAAGCAGAACTAGGTAGAAACAGAGGGCCAAAAT TGAATGCTATGCTTAGATTAGGGGTTTTGCAACCTGAGGTCT ATAAACAAAGTCTTCCTGGAAGTAATTGTAAGCATCC | 841 |
| | GGATGCTTACAATTACTTCCAGGAAGACTTTGTTTATAGACCT CAGGTTGCAAAACCCCTAATCTAAGCATAGCATTCAATTTTG GCCCTCTGTTTCTACCTAGTTCTGCTTGAATGTTTT | 842 |
| | GCTTAGATTAGGGGTTT | 843 |
| | AAACCCCTAATCTAAGC | 844 |
| Breast Cancer Ser-1130-Stop TCA to TGA | AGCAAGAATATGAAGAAGTAGTTCAGACTGTTAATACAGATTT CTCTCCATATCTGATTTCAGATAACTTAGAACAGCCTATGGGA AGTAGTCATGCATCTCAGGTTTGTTCTGAGACACC | 845 |
| | GGTGTCTCAGAACAAACCTGAGATGCATGACTACTTCCCATA GGCTGTTCTAAGTTATCTGAAATCAGATATGGAGAGAAATCT GTATTAACAGTCTGAACTACTTCTTCATATTCTTGCT | 846 |

TABLE 14-continued

BRCA1 Mutations and Genome-Correcting Oligos

| Clinical Phenotype & Mutation | Correcting Oligos | SEQ ID NO: |
|---|---|---|
| | TCTGATTTCAGATAACT | 847 |
| | AGTTATCTGAAATCAGA | 848 |
| Breast Cancer Lys-1183-Arg AAA to AGA | CTAGTTTTGCTGAAAATGACATTAAGGAAAGTTCTGCTGTTTT TAGCAAAAGCGTCCAGAAAGGAGAGCTTAGCAGGAGTCCTA GCCCTTTCACCCATACACATTTGGCTCAGGGTTACCG | 849 |
| | CGGTAACCCTGAGCCAAATGTGTATGGGTGAAAGGGCTAGG ACTCCTGCTAAGCTCTCCTTTCTGGACGCTTTTGCTAAAAACA GCAGAACTTTCCTTAATGTCATTTTCAGCAAAACTAG | 850 |
| | CGTCCAGAAAGGAGAGC | 851 |
| | GCTCTCCTTTCTGGACG | 852 |
| Breast Cancer Gln-1200-Stop CAG to TAG | AGCGTCCAGAAAGGAGAGCTTAGCAGGAGTCCTAGCCCTTT CACCCATACACATTTGGCTCAGGGTTACCGAAGAGGGGCCA AGAAATTAGAGTCCTCAGAAGAGAACTTATCTAGTGAGG | 853 |
| | CCTCACTAGATAAGTTCTCTTCTGAGGACTCTAATTTCTTGGC CCCTCTTCGGTAACCCTGAGCCAAATGTGTATGGGTGAAAGG GCTAGGACTCCTGCTAAGCTCTCCTTTCTGGACGCT | 854 |
| | ATTTGGCTCAGGGTTAC | 855 |
| | GTAACCCTGAGCCAAAT | 856 |
| Breast Cancer Arg-1203-Stop CAG to TAG | AAAGGAGAGCTTAGCAGGAGTCCTAGCCCTTTCACCCATACA CATTTGGCTCAGGGTTACCGAAGAGGGGCCAAGAAATTAGA GTCCTCAGAAGAGAACTTATCTAGTGAGGATGAAGAGC | 857 |
| | GCTCTTCATCCTCACTAGATAAGTTCTCTTCTGAGGACTCTAA TTTCTTGGCCCCTCTTCGGTAACCCTGAGCCAAATGTGTATG GGTGAAAGGGCTAGGACTCCTGCTAAGCTCTCCTTT | 858 |
| | AGGGTTACCGAAGAGGG | 859 |
| | CCCTCTTCGGTAACCCT | 860 |
| Breast Cancer Glu-1214-Stop GAG to TAG | ACCCATACATTTGGCTCAGGGTTACCGAAGAGGGGCCAA GAAATTAGAGTCCTCAGAAGAGAACTTATCTAGTGAGGATGA AGAGCTTCCCTGCTTCCAACACTTGTTATTTGGTAAAG | 861 |
| | CTTTACCAAATAACAAGTGTTGGAAGCAGGGAAGCTCTTCAT CCTCACTAGATAAGTTCTCTTCTGAGGACTCTAATTTCTTGGC CCCTCTTCGGTAACCCTGAGCCAAATGTGTATGGGT | 862 |
| | CCTCAGAAGAGAACTTA | 863 |
| | TAAGTTCTCTTCTGAGG | 864 |
| Breast Cancer Glu-1219-Asp GAG to GAC | TCAGGGTTACCGAAGAGGGGCCAAGAAATTAGAGTCCTCAG AAGAGAACTTATCTAGTGAGGATGAAGAGCTTCCCTGCTTCC AACACTTGTTATTTGGTAAAGTAAACAATATACCTTCT | 865 |
| | AGAAGGTATATTGTTTACTTTACCAAATAACAAGTGTTGGAAG CAGGGAAGCTCTTCATCCTCACTAGATAAGTTCTCTTCTGAG GACTCTAATTTCTTGGCCCCTCTTCGGTAACCCTGA | 866 |
| | TCTAGTGAGGATGAAGA | 867 |
| | TCTTCATCCTCACTAGA | 868 |
| Breast Cancer Glu-1221-Stop GAA to TAA | GGTTACCGAAGAGGGGCCAAGAAATTAGAGTCCTCAGAAGA GAACTTATCTAGTGAGGATGAAGAGCTTCCCTGCTTCCAACA CTTGTTATTTGGTAAAGTAAACAATATACCTTCTCAGT | 869 |
| | ACTGAGAAGGTATATTGTTTACTTTACCAAATAACAAGTGTTG GAAGCAGGGAAGCTCTTCATCCTCACTAGATAAGTTCTCTTC TGAGGACTCTAATTTCTTGGCCCCTTCGGTAACC | 870 |

TABLE 14-continued

BRCA1 Mutations and Genome-Correcting Oligos

| Clinical Phenotype & Mutation | Correcting Oligos | SEQ ID NO: |
|---|---|---|
| | GTGAGGATGAAGAGCTT | 871 |
| Breast Cancer Glu-1250-Stop GAG to TAG | TTATTTGGTAAACAATATACCTTCTCAGTCTACTAGGC ATAGCACCGTTGCTACCGAGTGTCTGTCTAAGAACACAGAGG AGAATTTATTATCATTGAAGAATAGCTTAAATGACT | 873 |
| | AGTCATTTAAGCTATTCTTCAATGATAATAAATTCTCCTCTGTG TTCTTAGACAGACACTCGGTAGCAACGGTGCTATGCCTAGTA GACTGAGAAGGTATATTGTTTACTTTACCAAATAA | 874 |
| | TTGCTACCGAGTGTCTG | 875 |
| | CAGACACTCGGTAGCAA | 876 |
| Breast Cancer Ser-1262-Stop TCA to TAA | CTAGGCATAGCACCGTTGCTACCGACTGTCTGTCTAAGAACA CAGAGGAGAATTTATTATCATTGAAGAATAGCTTAAATGACTG CAGTAACCAGGTAATATTGGCAAAGGCATCTCAGGA | 877 |
| | TCCTGAGATGCCTTTGCCAATATTACCTGGTTACTGCAGTCAT TTAAGCTATTCTTCAATGATAATAAATTCTCCTCTGTGTTCTTA GACAGACACTCGGTAGCAACGGTGCTATGCCTAG | 878 |
| | TTTATTATCATTGAAGA | 879 |
| | TCTTCAATGATAATAAA | 880 |
| Breast Cancer Gln-1281-Stop CAG to TAG | TTATCATTGAAGAATAGCTTAAATGACTGCAGTAACCAGGTAA TATTGGCAAAGGCATCTCAGGAACATCACCTTAGTGAGGAAA CAAAATGTTCTGCTAGCTTGTTTTCTTCACAGTGCA | 881 |
| | TGCACTGTGAAGAAAACAAGCTAGCAGAACATTTTGTTTCCTC ACTAAGGTGATGTTCCTGAGATGCCTTTGCCAATATTACCTG GTTACTGCAGTCATTTAAGCTATTCTTCAATGATAA | 882 |
| | AGGCATCTCAGGAACAT | 883 |
| | ATGTTCCTGAGATGCCT | 884 |
| Breast Cancer Gln-1313-Stop CAG to TAG | GCTAGCTTGTTTTCTTCACAGTGCAGTGAATTGGAAGACTTG ACTGCAAATACAAACACCCAGGATCCTTTCTTGATTCTT CCAAACAAATGAGGCATCAGTCTGAAAGCCAGGGAG | 885 |
| | CTCCCTGGCTTTCAGACTGATGCCTCATTTGTTGGAAGAAC CAATCAAGAAAGGATCCTGGGTGTTTGTATTTGCAGTCAAGT CTTCCAATTCACTGCACTGTGAAGAAAACAAGCTAGC | 886 |
| | CAAACACCCAGGATCCT | 887 |
| | AGGATCCTGGGTGTTTG | 888 |
| Breast Cancer Gln-1318-Stop ATT to GTT | TCACAGTGCAGTGAATTGGAAGACTTGACTGCAAATACAAAC ACCCAGGATCCTTTCTTGATTGGTTCTTCCAAACAAATGAGG CATCAGTCTGAAAGCCAGGGAGTTGGTCTGAGTGACA | 889 |
| | TGTCACTCAGACCAACTCCCTGGCTTTCAGACTGATGCCTCA TTTGTTTGGAAGAACCAATTCAAGAAAGGATCCTGGGTGTTTG TATTTGCAGTCAAGTCTTCCAATTCACTGCACTGTGA | 890 |
| | CTTTCTTGATTGGTTCT | 891 |
| | AGAACCAATTCAAGAAAG | 892 |
| Breast Cancer Gln-1323-Stop CAA to TAA | TTGGAAGACTTGACTGCAAATACAAACACCCAGGATCCTTTC TTGATTGGTTCTTCCAAACAAATGAGGCATCAGTCTGAAAGC CAGGGAGTTGGTCTGAGTGACAAGGAATTGGTTTCAG | 893 |
| | CTGAAACCAATTCCTTGTCACTCAGACCAACTCCCTGGCTTT CAGACTGATGCCTCATTTGTTTGGAAGAACCAATCAAGAAAG GATCCTGGGTGTTTGTATTTGCAGTCAAGTCTTCCAA | 894 |
| | CTTCCAAACAAATGAGG | 895 |
| | CCTCATTTGTTTGGAAG | 896 |

TABLE 14-continued

BRCA1 Mutations and Genome-Correcting Oligos

| Clinical Phenotype & Mutation | Correcting Oligos | SEQ ID NO: |
|---|---|---|
| Breast Cancer Arg-1347-Stop AGA to GGA | CAGTCTGAAAGCCAGGGAGTTGGTCTGAGTGACAAGGAATT GGTTTCAGATGATGAAGAAAGAGGAACGGGCTTGGAAGAAA ATAATCAAGAAGAGCAAAGCATGGATTCAAACTTAGGTA | 897 |
| | TACCTAAGTTTGAATCCATGCTTTGCTCTTCTTGATTATTTTCT TCCAAGCCCGTTCCTCTTTCTTCATCATCTGAAACCAATTCCT TGCACTCAGACCAACTCCCTGGCTTTCAGACTG | 898 |
| | ATGAAGAAAGAGGAACG | 899 |
| | CGTTCCTCTTTCTTCAT | 900 |
| Breast Cancer Gln-1395-Stop CAG to TAG | GAAACAAGCGTCTCTGAAGACTGCTCAGGGCTATCCTCTCAG AGTGACATTTTAACCACTCAGGTAAAAGCGTGTGTGTGTGT GCACATGCGTGTGTGTGGTGTCCTTTGCATTCAGTAG | 901 |
| | CTACTGAATGCAAAGGACACCACACACACGCATGTGCACACA CACACACGCTTTTTACCTGAGTGGTTAAAATGTCACTCTGAG AGGATAGCCCTGAGCAGTCTTCAGAGACGCTTGTTTC | 902 |
| | TAACCACTCAGGTAAAA | 903 |
| | TTTTACCTGAGTGGTTA | 904 |
| Breast Cancer Gln-1408-Stop CAG to TAG | TGGTGCCATTTATCGTTTTTGAAGCAGAGGGATACCATGCAA CATAACCTGATAAAGCTCCAGCAGGAAATGGCTGAACTAGAA GCTGTGTTAGAACAGCATGGGAGCCAGCCTTCTAACA | 905 |
| | TGTTAGAAGGCTGGCTCCCATGCTGTTCTAACACAGCTTCTA GTTCAGCCATTTCCTGCTGGAGCTTTATCAGGTTATGTTGCAT GGTATCCCTCTGCTTCAAAAACGATAAATGGCACCA | 906 |
| | TAAAGCTCCAGCAGGAA | 907 |
| | TTCCTGCTGGAGCTTTA | 908 |
| Breast Cancer Arg-1443-Gly CGA to GGA Arg-1443-Stop CGA to TGA | AGCCAGCCTTCTAACAGCTACCCTTCCATCATAAGTGACTCT TCTGCCCTTGAGGACCTGCGAAATCCAGAACAAAGCACATCA GAAAAAGGTGTGTATTGTTGGCCAAACACTGATATCT | 909 |
| | AGATATCAGTGTTTGGCCAACAATACACACCTTTTTCTGATGT GCTTTGTTCTGGATTTCGCAGGTCCTCAAGGGCAGAAGAGTC ACTTATGATGGAAGGGTAGCTGTTAGAAGGCTGGCT | 910 |
| | AGGACCTGCGAAATCCA | 911 |
| | TGGATTTCGCAGGTCCT | 912 |
| Breast Cancer Ser-1512-Ile AGT to ATT | CAGAATAGAAACTACCCATCTCAAGAGGAGCTCATTAAGGTT GTTGATGTGGAGGAGCAACAGCTGGAAGAGTCTGGGCCACA CGATTTGACGGAAACATCTTACTTGCCAAGGCAAGATC | 913 |
| | GATCTTGCCTTGGCAAGTAAGATGTTTCCGTCAAATCGTGTG GCCCAGACTCTTCCAGCTGTTGCTCCTCCACATCAACAACCT TAATGAGCTCCTCTTGAGATGGGTAGTTTCTATTCTG | 914 |
| | AGGAGCAACAGCTGGAA | 915 |
| | TTCCAGCTGTTGCTCCT | 916 |
| Breast Cancer Gln-1538-Stop CAG to TAG | ATCTTTCTAGGTCATCCCCTTCTAAATGCCCATCATTAGATGA TAGGTGGTACATGCACAGTTGCTCTGGGAGTCTTCAGAATAG AAACTACCCATCTCAAGAGGAGCTCATTAAGGTTGT | 917 |
| | ACAACCTTAATGAGCTCCTCTTGAGATGGGTAGTTTCTATTCT GAAGACTCCCAGAGCAACTGTGCATGTACCACCTATCATCAT ATGATGGGCATTTAGAAGGGGATGACCTAGAAAGAT | 918 |
| | CATGCACAGTTGCTCTG | 919 |
| | CAGAGCAACTGTGCATG | 920 |
| Breast Cancer | CAGAATAGAAACTACCCATCTCAAGAGGAGCTCATTAAGGTT | 921 |

TABLE 14-continued

BRCA1 Mutations and Genome-Correcting Oligos

| Clinical Phenotype & Mutation | Correcting Oligos | SEQ ID NO: |
|---|---|---|
| Glu-1541-Stop GAG to TAG | GTTGATGTGGAGGAGCAACAGCTGGAAGAGTCTGGGCCACA CGATTTGACGGAAACATCTTACTTGCCAAGGCAAGATC | |
| | GATCTTGCCTTGGCAAGTAAGATGTTTCCGTCAAATCGTGTG GCCCAGACTCTTCCAGCTGTTGCTCCTCCACATCAACAACCT TAATGAGCTCCTCTTGAGATGGGTAGTTTCTATTCTG | 922 |
| | AGGAGCAACAGCTGGAA | 923 |
| | TTCCAGCTGTTGCTCCT | 924 |
| Breast Cancer Thr-1561-Ile ACC to ATC | AACTACCCATCTCAAGAGGAGCTCATTAAGGTTGTTGATGTG GAGGAGCAACAGCTGGAAGAGTCTGGGCCACACGATTTGAC GGAAACATCTTACTTGCCAAGGCAAGATCTAGGTAATA | 925 |
| | TATTACCTAGATCTTGCCTTGGCAAGTAAGATGTTTCCGTCAA ATCGTGTGGCCCAGACTCTTCCAGCTGTTGCTCCTCCACATC AACAACCTTAATGAGCTCCTCTTGAGATGGGTAGTT | 926 |
| | AGCTGGAAGAGTCTGGG | 927 |
| | CCCAGACTCTTCCAGCT | 928 |
| Breast Cancer Tyr-1563-Stop TAC to TAG | TTTGTAATTCAACATTCATCGTTGTGTAAATTAAACTTCTCCCA TTCCTTTCAGAGGGGAACCCCTTACCTGGAATCTGGAATCAGC CTCTTCTCTGATGACCCTGAATCTGATCCTTCTGA | 929 |
| | TCAGAAGGATCAGATTCAGGGTCATCAGAGAAGAGGCTGATT CCAGATTCCAGGTAAGGGGTTCCCTCTGAAAGGAATGGGAG AAGTTTAATTTACACAACGATGAATGTTGAATTACAAA | 930 |
| | AGAGGGAACCCCTTACC | 931 |
| | GGTAAGGGGTTCCCTCT | 932 |
| Breast Cancer Leu-1564-Pro CTG to CCG | CAACATTCATCGTTGTGTAAATTAAACTTCTCCCATTCCTTTC AGAGGGAACCCCTTACCTGGAATCTGGAATCAGCCTCTTCTC TGATGACCCTGAATCTGATCCTTCTGAAGACAGAGC | 933 |
| | GCTCTGTCTTCAGAAGGATCAGATTCAGGGTCATCAGAGAAG AGGCTGATTCCAGATTCCAGGTAAGGGGTTCCCTCTGAAAG GAATGGGAGAAGTTTAATTTACACAACGATGAATGTTG | 934 |
| | CCCTTACCTGGAATCTG | 935 |
| | CAGATTCCAGGTAAGGG | 936 |
| Breast Cancer Gln-1604-Stop CAA to TAA | GCCCCAGAGTCAGCTCGTGTTGGCAACATACCATCTTCAACC TCTGCATTGAAAGTTCCCCAATTGAAAGTTGCAGAATCTGCC CAGAGTCCAGCTGCTGCTCATACTACTGATACTGCTG | 937 |
| | CAGCAGTATCAGTAGTATGAGCAGCAGCTGGACTCTGGGCA GATTCTGCAACTTTCAATTGGGGAACTTTCAATGCAGAGGTT GAAGATGGTATGTTGCCAACACGAGCTGACTCTGGGGC | 938 |
| | AAGTTCCCCAATTGAAA | 939 |
| | TTTCAATTGGGGAACTT | 940 |
| Breast Cancer Lys-1606-Glu AAA to GAA | GAGTCAGCTCGTGTTGGCAACATACCATCTTCAACCTCTGCA TTGAAAGTTCCCCAATTGAAAGTTGCAGAATCTGCCCAGAGT CCAGCTGCTGCTCATACTACTGATACTGCTGGGTATA | 941 |
| | TATACCCAGCAGTATCAGTAGTATGAGCAGCAGCTGGACTCT GGGCAGATTCTGCAACTTTCAATTGGGGAACTTTCAATGCAG AGGTTGAAGATGGTATGTTGCCAACACGAGCTGACTC | 942 |
| | CCCAATTGAAAGTTGCA | 943 |
| | TGCAACTTTTCAATTGGG | 944 |
| Breast Cancer Met-1628-Thr ATG to ACG | CAGAATCTGCCCAGAGTCCAGCTGCTGCTCATACTACTGATA CTGCTGGGTATAATGCAATGGAAGAAAGTGTGAGCAGGGAG AAGCCAGAATTGACAGCTTCAACAGAAAGGGTCAACAA | 945 |

TABLE 14-continued

BRCA1 Mutations and Genome-Correcting Oligos

| Clinical Phenotype & Mutation | Correcting Oligos | SEQ ID NO: |
|---|---|---|
| | TTGTTGACCCTTTCTGTTGAAGCTGTCAATTCTGGCTTCTCCC TGCTCACACTTTCTTCCATTGCATTATACCCAGCAGTATCAGT AGTATGAGCAGCAGCTGGACTCTGGGCAGATTCTG | 946 |
| | TAATGCAATGGAAGAAA | 947 |
| | TTTCTTCCATtGCATTA | 948 |
| Breast Cancer Met-1628-Val ATG to GTG | GCAGAATCTGCCCAGAGTCCAGCTGCTGCTCATACTACTGAT ACTGCTGGGTATAATGCAATGGAAGAAAGTGTGAGCAGGGA GAAGCCAGAATTGACAGCTTCAACAGAAAGGGTCAACA | 949 |
| | TGTTGACCCTTTCTGTTGAAGCTGTCAATTCTGGCTTCTCCCT GCTCACACTTTCTTCCATTGCATTATACCCAGCAGTATCAGTA GTATGAGCAGCAGCTGGACTCTGGGCAGATTCTGC | 950 |
| | ATAATGCAATGGAAGAA | 951 |
| | TTCTTCCATTGCATTAT | 952 |
| Breast Cancer Pro-1637-Leu CCA to CTA | CTCATACTACTGATACTGCTGGGTATAATGCAATGGAAGAAA GTGTGAGCAGGGAGAAGCCAGAATTGACAGCTTCAACAGAA AGGGTCAACAAAAGAATGTCCATGGTGGTGTCTGGCCT | 953 |
| | AGGCCAGACACCACCATGGACATTCTTTTGTTGACCCTTTCT GTTGAAGCTGTCAATTCTGGCTTCTCCCTGCTCACACTTTCTT CCATTGCATTATACCCAGCAGTATCAGTAGTATGAG | 954 |
| | GGAGAAGCCAGAATTGA | 955 |
| | TCAATTCTGGCTTCTCC | 956 |
| Breast Cancer Met-1652-Ile ATG to ATA | GAGCAGGGAGAAGCCAGAAtTGACAGCTTCAACAGAAAGGG TCAACAAAAGAATGTCCATGGTGGTGTCTGGCCTGACCCCAG AAGAATTTGTGAGTGTATCCATATGTATCTCCCTAATG | 957 |
| | CATTAGGGAGATACATATGGATACACTCACAAATTCTTCTGG GGTCAGGCCAGACACCACCATGGACATTCTTTTGTTGACCCT TTCTGTTGAAGCTGTCAATTCTGGCTTCTCCCTGCTC | 958 |
| | ATGTCCATGGTGGTGTC | 959 |
| | GACACCACCATGGACAT | 960 |
| Breast Cancer Glu-1694-Stop GAG to TAG | CACTTCCTGATTTTGTTTTCAACTTCTAATCCTTTGAGTGTTTT TCATTCTGCAGATGCTGAGTTTGTGTGTGAACGGACACTAA ATATTTTCTAGGAATTGCGGGAGGAAAATGGGTAG | 961 |
| | CTACCCATTTTCCTCCCGCAATTCCTAGAAAATATTTCAGTGT CCGTTCACACACAAACTCAGCATCTGCAGAATGAAAAACACT CAAAGGATTAGAAGTTGAAAACAAAATCAGGAAGTG | 962 |
| | CAGATGCTGAGTTTGTG | 963 |
| | CACAAACTCAGCATCTG | 964 |
| Breast Cancer Gly-1706-Glu GGA to GAA | GTGTTTTTTCATTCTGCAGATGCTGAGTTTGTGTGTGAACGGA CACTGAAATATTTTCTAGGAATTGCGGGAGGAAAATGGGTAG TTAGCTATTTCTGTAAGTATAATACTATTTCTCCCCT | 965 |
| | AGGGGAGAAATAGTATTATACTTACAGAAATAGCTAACTACCC ATTTTCCTCCCGCAATTCCTAGAAAATATTTCAGTGTCCGTTC ACACACAAACTCAGCATCTGCAGAATGAAAAACAC | 966 |
| | TTTTCTAGGAATTGCGG | 967 |
| | CCGCAATTCCTAGAAAA | 968 |
| Breast Cancer Ala-1708-Glu GCG to GAG | TTCATTCTGCAGATGCTGAGTTTGTGTGTGAACGGACACTGA AATATTTTCTAGGAATTGCGGGAGGAAAATGGGTAGTTAGCT ATTTCTGTAAGTATAATACTATTTCTCCCCTCCTCCC | 969 |
| | GGGAGGAGGGGAGAAATAGTATTATACTTACAGAAATAGCTA | 970 |

TABLE 14-continued

BRCA1 Mutations and Genome-Correcting Oligos

| Clinical Phenotype & Mutation | Correcting Oligos | SEQ ID NO: |
|---|---|---|
| | ACTACCCATTTTCCTCCCGCAATTCCTAGAAAATATTTCAGTG TCCGTTCACACACAAACTCAGCATCTGCAGAATGAA | |
| | AGGAATTGCGGGAGGAA | 971 |
| | TTCCTCCCGCAATTCCT | 972 |
| Breast Cancer Val-1713-Ala GTA to GCA | CTGAGTTTGTGTGTGAACGGACACTGAAATATTTTCTAGGAAT TGCGGGAGGAAAATGGGTAGTTAGCTATTTCTGTAAGTATAA TACTATTTCTCCCCTCCTCCCTTTAACACCTCAGAA | 973 |
| | TTCTGAGGTGTTAAAGGGAGGAGGGGAGAAATAGTATTATAC TTACAGAAATAGCTAACTACCCATTTTCCTCCCGCAATTCCTA GAAAATATTTCAGTGTCCGTTCACACACAAACTCAG | 974 |
| | AAAATGGGTAGTTAGCT | 975 |
| | AGCTAACTACCCATTTT | 976 |
| Breast Cancer Trp-1718-Stop TGG to TAG | AACGGACACTGAAATATTTTCTAGGAATTGCGGGAGGAAAAT GGGTAGTTAGCTATTTCTGTAAGTATAATACTATTTCTCCCCT CCTCCCTTTAACACCTCAGAATTGCATTTTTACACC | 977 |
| | GGTGTAAAAATGCAATTCTGAGGTGTTAAAGGGAGGAGGGG AGAAATAGTATTATACTTACAGAAATAGCTAACTACCCATTTTC CTCCCGCAATTCCTAGAAAATATTTCAGTGTCCGTT | 978 |
| | CTATTTCTGTAAGTATA | 979 |
| | TATACTTACAGAAATAG | 980 |
| Breast Cancer Glu-1725-Stop GAA to TAA | TTCTGCTGTATGTAACCTGTCTTTTCTATGATCTCTTTAGGGG TGACCCAGTCTATTAAAGAAAGAAAAATGCTGAATGAGGTAA GTACTTGATGTTACAAACTAACCAGAGATATTCATT | 981 |
| | AATGAATATCTCTGGTTAGTTTGTAACATCAAGTACTTACCTC ATTCAGCATTTTTCTTTCTTTAATAGACTGGGTCACCCCTAAA GAGATCATAGAAAAGACAGGTTACATACAGCAGAA | 982 |
| | CTATTAAAGAAAGAAAA | 983 |
| | TTTTCTTTCTTTAATAG | 984 |
| Breast Cancer Lys-1727-Stop AAA to TAA | TGTATGTAACCTGTCTTTTCTATGATCTCTTTAGGGGTGACCC AGTCTATTAAAGAAAGAAAAATGCTGAATGAGGTAAGTACTTG ATGTTACAAACTAACCAGAGATATTCATTCAGTCA | 985 |
| | TGACTGAATGAATATCTCTGGTTAGTTTGTAACATCAAGTACT TACCTCATTCAGCATTTTTCTTTCTTTAATAGACTGGGTCACC CCTAAAGAGATCATAGAAAAGACAGGTTACATACA | 986 |
| | AAGAAAGAAAAATGCTG | 987 |
| | CAGCATTTTTCTTTCTT | 988 |
| Breast Cancer Pro-1749-Arg CCA to CGA | TCTTTCAGCATGATTTTGAAGTCAGAGGAGATGTGGTCAATG GAAGAAACCACCAAGGTCCAAAGCGAGCAAGAGAATCCCAG GACAGAAAGGTAAAGCTCCCTCCCTCAAGTTGACAAAA | 989 |
| | TTTTGTCAACTTGAGGGAGGGAGCTTTACCTTTCTGTCCTGG GATTCTCTTGCTCGCTTTGGACCTTGGTGGTTTCTTCCATTGA CCACATCTCCTCTGACTTCAAAATCATGCTGAAAGA | 990 |
| | CCAAGGTCCAAAGCGAG | 991 |
| | CTCGCTTTGGACCTTGG | 992 |
| Breast Cancer Arg-1751-Stop CGA to TGA | CAGCATGATTTTGAAGTCAGAGGAGATGTGGTCAATGGAAGA AACCACCAAGGTCCAAAGCGAGCAAGAGAATCCCAGGACAG AAAGGTAAAGCTCCCTCCCTCAAGTTGACAAAAATCTC | 993 |
| | GAGATTTTGTCAACTTGAGGGAGGGAGCTTTACCTTTCTGT CCTGGGATTCTCTTGCTCGCTTTGGACCTTGGTGGTTTCTTC CATTGACCACATCTCCTCTGACTTCAAAATCATGCTG | 994 |

TABLE 14-continued

BRCA1 Mutations and Genome-Correcting Oligos

| Clinical Phenotype & Mutation | Correcting Oligos | SEQ ID NO: |
|---|---|---|
| | GTCCAAAGCGAGCAAGA | 995 |
| | TCTTGCTCGCTTTGGAC | 996 |
| Breast Cancer Gln-1756-Stop CAG to TAG | GTCAGAGGAGATGTGGTCAATGGAAGAAACCACCAAGGTCC AAAGCGAGCAAGAGAATCCCAGGACAGAAAGGTAAAGCTCC CTCCCTCAAGTTGACAAAAATCICACCCCACCACTCTGT | 997 |
| | ACAGAGTGGTGGGGTGAGATTTTTGTCAACTTGAGGGAGGG AGCTTTACCTTTCTGTCCTGGGATTCTCTTGCTCGCTTTGGA CCTTGGTGGTTTCTTCCATTGACCACATCTCCTCTGAC | 998 |
| | GAGAATCCCAGGACAGA | 999 |
| | TCTGTCCTGGGATTCTC | 1000 |
| Breast Cancer Met-1775-Arg ATG to AGG | CTCTCTTCTTCCAGATCTTCAGGGGGCTAGAAATCTGTTGCT ATGGGCCCTTCACCAACATGCCCACAGGTAAGAGCCTGGGA GAACCCCAGAGTTCCAGCACCAGCCTTTGTCTTACATA | 1001 |
| | TATGTAAGACAAAGGCTGGTGCTGGAACTCTGGGGTTCTCCC AGGCTCTTACCTGTGGGCATGTTGGTGAAGGGCCCATAGCA ACAGATTTCTAGCCCCCTGAAGATCTGGAAGAAGAGAG | 1002 |
| | CACCAACATGCCCACAG | 1003 |
| | CTGTGGGCATGTTGGTG | 1004 |
| Breast Cancer Trp-1782-Stop TGG to TGA | AGTATGCAGATTACTGCAGTGATTTTACATCTAAAATGTCCATT TTAGATCAACTGGAATGGATGGTACAGCTGTGTGGTGCTTCT GTGGTGAAGGAGCTTTCATCATTCACCCTTGGCACA | 1005 |
| | TGTGCCAAGGGTGAATGATGAAAGCTCCTTCACCACAGAAGC ACCACACAGCTGTACCATCCATTCCAGTTGATCTAAAATGGA CATTTAGATGTAAAATCACTGCAGTAATCTGCATACT | 1006 |
| | CTGGAATGGATGGTACA | 1007 |
| | TGTACCATCCATTCCAG | 1008 |
| Breast Cancer Gln-1785-His CAG to CAT | ATTACTGCAGTGATTTTACATCTAAATGTCCATTTTAGATCAAC TGGAATGGATGGTACAGCTGTGTGGTGCTTCTGTGGTGAAG GAGCTTTCATCATTCACCCTTGGCACAGTAAGTATT | 1009 |
| | AATACTTACTGTGCCAAGGGTGAATGATGAAAGCTCCTTCAC CACAGAAGCACCACACAGCTGTACCATCCATTCCAGTTGATC TAAAATGGACATTTAGATGTAAAATCACTGCAGTAAT | 1010 |
| | ATGGTACAGCTGTGTGG | 1011 |
| | CCACACAGCTGTACCAT | 1012 |
| Breast Cancer Glu-1794-Asp GAG to GAT | GTCCATTTTAGATCAACTGGAATGGATGGTACAGCTGTGTGG TGCTTCTGTGGTGAAGGAGCTTTCATCATTCACCCTTGGCAC AGTAAGTATTGGGTGCCCTGTCAGAGAGGGAGGACAC | 1013 |
| | GTGTCCTCCCTCTCTGACAGGGCACCCAATACTTACTGTGCC AAGGGTGAATGATGAAAGCTCCTTCACCACAGAAGCACCACA CAGCTGTACCATCCATTCCAGTTGATCTAAAATGGAC | 1014 |
| | GTGAAGGAGCTTTCATC | 1015 |
| | GATGAAAGCTCCTTCAC | 1016 |
| Breast Cancer Arg-1835-Stop CGA to TGA | CTCTGCTTGTGTTCTCTGTCTCCAGCAATTGGGCAGATGTGT GAGGCACCTGTGGTGACCCGAGAGTGGGTGTTGGACAGTGT AGCACTCTACCAGTGCCAGGAGCTGGACACCTACCTGA | 1017 |
| | TCAGGTAGGTGTCCAGCTCCTGGCACTGGTAGAGTGCTACA CTGTCCAACACCCACTCTCGGGTCACCACAGGTGCCTCACA CATCTGCCCAATTGCTGGAGACAGAGAACACAAGCAGAG | 1018 |

TABLE 14-continued

BRCA1 Mutations and Genome-Correcting Oligos

| Clinical Phenotype & Mutation | Correcting Oligos | SEQ ID NO: |
|---|---|---|
| | TGGTGACCCGAGAGTGG | 1019 |
| | CCACTCTCGGGTCACCA | 1020 |
| Breast Cancer Trp-1837-Arg TGG to CGG | TTGTGTTCTCTGTCTCCAGCAATTGGGCAGATGTGTGAGGCA CCTGTGGTGACCCGAGAGTGGGTGTTGGACAGTGTAGCACT CTACCAGTGCCAGGAGCTGGACACCTACCTGATACCCC | 1021 |
| | GGGGTATCAGGTAGGTGTCCAGCTCCTGGCACTGGTAGAGT GCTACACTGTCCAACACCCACTCTCGGGTCACCACAGGTGC CTCACACATCTGCCCAATTGCTGGAGACAGAGAACACAA | 1022 |
| | CCCGAGAGTGGGTGTTG | 1023 |
| | CAACACCCACTCTCGGG | 1024 |
| Breast Cancer Trp-1837-Stop TGG to TAG | TGTGTTCTCTGTCTCCAGCAATTGGGCAGATGTGTGAGGCAC CTGTGGTGACCCGAGAGTGGGTGTTGGACAGTGTAGCACTC TACCAGTGCCAGGAGCTGGACACCTACCTGATACCCCA | 1025 |
| | TGGGGTATCAGGTAGGTGTCCAGCTCCTGGCACTGGTAGAG TGCTACACTGTCCAACACCCACTCTCGGGTCACCACAGGTG CCTCACACATCTGCCCAATTGCTGGAGACAGAGAACACA | 1026 |
| | CCGAGAGTGGGTGTTGG | 1027 |
| | CCAACACCCACTCTCGG | 1028 |

TABLE 15

BRCA2 Mutations and Genome-Correcting Oligos

| Clinical Phenotype & Mutation | Correcting Oligos | SEQ ID NO: |
|---|---|---|
| Breast cancer PHE32LEU TTT to CTT | GTTAAAACTAAGGTGGGATTTTTTTTTTAAATAGATTTAGGAC CAATAAGTCTTAATTGGTTTGAAGAACTTTCTTCAGAAGCTCC ACCCTATAATTCTGAACCTGCAGAAGAATCTGAAC | 1029 |
| | GTTCAGATTCTTCTGCAGGTTCAGAATTATAGGGTGGAGCTT CTGAAGAAAGTTCTTCAAACCAATTAAGACTTATTGGTCCTAA ATCTATTTAAAAAAAAAAATCCCACCTTAGTTTTAAC | 1030 |
| | TTAATTGGTTTGAAGAA | 1031 |
| | TTCTTCAAACCAATTAA | 1032 |
| Breast cancer TYR42CYS TAT to TGT | TAGATTTAGGACCAATAAGTCTTAATTGGTTTGAAGAACTTTC TTCAGAAGCTCCACCCTATAATTCTGAACCTGCAGAAGAATC TGAACATAAAAACAACAATTACGAACCAAACCTATT | 1033 |
| | AATAGGTTTGGTTCGTAATTGTTGTTTTTATGTTCAGATTCTTC TGCAGGTTCAGAATTATAGGGTGGAGCTTCTGAAGAAGTTC TTCAAACCAATTAAGACTTATTGGTCCTAAATCTA | 1034 |
| | TCCACCCTATAATTCTG | 1035 |
| | CAGAATTATAGGGTGGA | 1036 |
| Breast cancer LYS53ARG AAA to AGA | AAGAACTTTCTTCAGAAGCTCCACCCTATAATTCTGAACCTGC AGAAGAATCTGAACATAAAAACAACAATTACGAACCAAACCTA TTTAAAACTCCACAAAGGAAACCATCTTATAATCA | 1037 |
| | TGATTATAAGATGGTTTCCTTTGTGGAGTTTTAAATAGGTTTG GTTCGTAATTGTTGTTTTTATGTTCAGATTCTTCTGCAGGTTC AGAATTATAGGGTGGAGCTTCTGAAGAAAGTTCTT | 1038 |
| | TGAACATAAAAACAACA | 1039 |
| | TGTTGTTTTTATGTTCA | 1040 |

TABLE 15-continued

BRCA2 Mutations and Genome-Correcting Oligos

| Clinical Phenotype & Mutation | Correcting Oligos | SEQ ID NO: |
|---|---|---|
| Breast cancer Phe81Leu TTC to CTC | CTATTTAAAACTCCACAAAGGAAACCATCTTATAATCAGCTGG CTTCAACTCCAATAATATTCAAAGAGCAAGGGCTGACTCTGC CGCTGTACCAATCTCCTGTAAAAGAATTAGATAAAT | 1041 |
| | ATTTATCTAATTCTTTTACAGGAGATTGGTACAGCGGCAGAGT CAGCCCTTGCTCTTTGAATATTATTGGAGTTGAAGCCAGCTG ATTATAAGATGGTTTCCTTTGTGGAGTTTTAAATAG | 1042 |
| | CAATAATATTCAAAGAG | 1043 |
| | CTCTTTGAATATTATTG | 1044 |
| Breast cancer TRP194TERM TGG to TAG | GTCAGACACCAAAACATATTTCTGAAAGTCTAGGAGCTGAGG TGGATCCTGATATGTCTTGGTCAAGTTCTTTAGCTACACCACC CACCCTTAGTTCTACTGTGCTCATAGGTAATAATAG | 1045 |
| | CTATTATTACCTATGAGCACAGTAGAACTAAGGGTGGGTGGT GTAGCTAAAGAACTTGACCAAGACATATCAGGATCCACCTCA GCTCCTAGACTTTCAGAAATATGTTTTGGTGTCTGAC | 1046 |
| | TATGTCTTGGTCAAGTT | 1047 |
| | AACTTGACCAAGACATA | 1048 |
| Breast cancer PRO201ARG CCA to CGA | CTGAAAGTCTAGGAGCTGAGGTGGATCCTGATATGTCTTGGT CAAGTTCTTTAGCTACACCACCCACCCTTAGTTCTACTGTGCT CATAGGTAATAATAGCAAATGTGTATTTACAAGAAA | 1049 |
| | TTTCTTGTAAATACACATTTGCTATTATTACCTATGAGCACAGT AGAACTAAGGGTGGGTGGTGTAGCTAAAGAACTTGACCAAGA CATATCAGGATCCACCTCAGCTCCTAGACTTTCAC | 1050 |
| | AGCTACACCACCCACCC | 1051 |
| | GGGTGGGTGGTGTAGCT | 1052 |
| Breast cancer Pro222Ser CCT to TCT | ACAATACACATAAATTTTTATCTTACAGTCAGAAATGAAGAAG CATCTGAAACTGTATTTCCTCATGATACTACTGCTGTAAGTAA ATATGACATTGATTAGACTGTTGAAATTGCTAACA | 1053 |
| | TGTTAGCAATTTCAACAGTCTAATCAATGTCATATTTACTTACA GCAGTAGTATCATGAGGAAATACAGTTTCAGATGCTTCTTCAT TTCTGACTGTAAGATAAAAATTTATGTGTATTGT | 1054 |
| | CTGTATTTCCTCATGAT | 1055 |
| | ATCATGAGGAAATACAG | 1056 |
| Breast cancer Leu-414-Term TTG to TAG | AATGGTCTCAACTAACCCTTTCAGGTCTAAATGGAGCCCAGA TGGAGAAAATACCCCTATTGCATATTTCTTCATGTGACCAAAA TATTTCAGAAAAAGACCTATTAGACACAGAGAACAA | 1057 |
| | TTGTTCTCTGTGTCTAATAGGTCTTTTTCTGAAATATTTTGGTC ACATGAAGAAATATGCAATAGGGGTATTTTCTCCATCTGGGC TCCATTTAGACCTGAAAGGGTTAGTTGAGACCATT | 1058 |
| | ACCCCTATTGCATATTT | 1059 |
| | AAATATGCAATAGGGGT | 1060 |
| Breast cancer, male Cys554Trp TGT to TGG | AGCCTCTGAAAGTGGACTGGAAATACATACTGTTGCTCACA GAAGGAGGACTCCTTATGTCCAAATTTAATTGATAATGGAAG CTGGCCAGCCACCACCACACAGAATTCTGTAGCTTTG | 1061 |
| | CAAAGCTACAGAATTCTGTGTGGTGGTGGCTGGCCAGCTTC CATTATCAATTAAATTTGGACATAAGGAGTCCTCCTTCTGTGA GCAAACAGTATGTATTTCCAGTCCACTTTCAGAGGCT | 1062 |
| | TCCTTATGTCCAAATTT | 1063 |
| | AAATTTGGACATAAGGA | 1064 |

TABLE 15-continued

BRCA2 Mutations and Genome-Correcting Oligos

| Clinical Phenotype & Mutation | Correcting Oligos | SEQ ID NO: |
|---|---|---|
| Breast cancer Lys944Term AAA to TAA | AACTCTACCATGGTTTTATATGGAGACACAGGTGATAAACAA GCMCCCAAGTGTCAATTAAAAAAGATTTGGTTTATGTTCTTG CAGAGGAGAACAAAAATAGTGTAAAGCAGCATATAA | 1065 |
| | TTATATGCTGCTTTACACTATTTTTGTTCTCCTCTGCAAGAAC ATAAACCAAATCTTTTTTAATTGACACTTGGGTTGCTTGTTTAT CACCTGTGTCTCCATATAAAACCATGGTAGAGTT | 1066 |
| | TGTCAATTAAAAAAGAT | 1067 |
| | ATCTTTTTTAATTGACA | 1068 |
| Breast cancer, male Glu1320Term GAA to TAA | ATGACTACTGGCACTTTTGTTGAAGAAATTACTGAAAATTACA AGAGAAATACTGAAATGAAGATAACAAATATACTGCTGCCAG TAGAAATTCTCATAACTTAGAATTTGATGGCAGTG | 1069 |
| | CACTGCCATCAAATTCTAAGTTATGAGAATTTCTACTGGCAGC AGTATATTTGTTATCTTCATTTCAGTATTTCTCTTGTAATTTTC AGTAATTTCTTCAACAAAAGTGCCAGTAGTCAT | 1070 |
| | CTGAAAATGAAGATAAC | 1071 |
| | GTTATCTTCATTTTCAG | 1072 |
| Breast cancer Glu1876Term GAA to TAA | CATGAAACAATTAAAAAAGTGAAAGACATATTTACAGACAGTT TCAGTAAAGTAATTAAGGAAAACAACGAGAATAAATCAAAAAT TTGCCAAACGAAAATTATGGCAGGTTGTTACGAGG | 1073 |
| | CCTCGTAACAACCTGCCATAATTTTCGTTTGGCAAATTTTTGA TTTATTCTCGTTGTTTTCCTTAATTACTTTACTGAAACTGTCTG TAAATATGTCTTTCACTTTTTTAATTGTTTCATG | 1074 |
| | TAATTAAGGAAAACAAC | 1075 |
| | GTTGTTTTCCTTAATTA | 1076 |
| Breast cancer Ser1882Term TCA to TAA | TGAAAGACATATTTACAGACAGTTTCAGTAAAGTAATTAAGGA AAACAACGAGAATAAATCAAAAATTTGCCAAACGAAAATTATG GCAGGTTGTTACGAGGCATTGGATGATTCAGAGGA | 1077 |
| | TCCTCTGAATCATCCAATGCCTCGTAACAACCTGCCATAATTT TCGTTTGGCAAATTTTTGATTTATTCTCGTTGTTTTCCTTAATT ACTTTACTGAAACTGTCTGTAAATATGTCTTTCA | 1078 |
| | GAATAAATCAAAAATTT | 1079 |
| | AAATTTTTGATTTATTC | 1080 |
| Breast cancer Glu1953Term GAA to TAA | AACCAAAATATGTCTGGATTGGAGAAAGTTTCTAAAATATCAC CTTGTGATGTTAGTTTGGAAACTTCAGATATATGTAAATGTAG TATAGGGAAGCTTCATAAGTCAGTCTCATCTGCAA | 1081 |
| | TTGCAGATGAGACTGACTTATGAAGCTTCCCTATACTACATTT ACATATATCTGAAGTTTCCAAACTAACATCACAAGGTGATATT TTAGAAACTTTCTCCAATCCAGACATATTTTGGTT | 1082 |
| | TTAGTTTGGAAACTTCA | 1083 |
| | TGAAGTTTCCAAACTAA | 1084 |
| Breast cancer Ser1970Term TCA to TAA | TTAGTTTGGAAACTTCAGATATATGTAAATGTAGTATAGGGAA GCTTCATAAGTCAGTCTCATCTGCAAATACTTGTGGGATTTTT AGCACAGCAAGTGGAAAATCTGTCCAGGTATCAGA | 1085 |
| | TCTGATACCTGGACAGATTTTCCACTTGCTGTGCTAAAAATCC CACAAGTATTTGCAGATGAGACTGACTTATGAAGCTTCCCTAT ACTACATTTACATATATCTGAAGTTTCCAAACTAA | 1086 |
| | GTCAGTCTCATCTGCAA | 1087 |
| | TTGCAGATGAGACTGAC | 1088 |

TABLE 15-continued

BRCA2 Mutations and Genome-Correcting Oligos

| Clinical Phenotype & Mutation | Correcting Oligos | SEQ ID NO: |
|---|---|---|
| Breast cancer Gln1987Term GAG to TAG | AAGTCAGTCTCATCTGCAAATACTTGTGGGATTTTTAGCACAG CAAGTGGAAAATCTGTCCAGGTATCAGATGCTTCATTACAAAA CGCAAGACAAGTGTTTTCTGAAATAGAAGATAGTA | 1089 |
| | TACTATCTTCTATTTCAGAAAACACTTGTCTTGCGTTTTGTAAT GAAGCATCTGATACCTGGACAGATTTTCCACTTGCTGTGCTA AAAATCCCACAAGTATTTGCAGATGAGACTGACTT | 1090 |
| | AATCTGTCCAGGTATCA | 1091 |
| | TGATACCTGGACAGATT | 1092 |
| Breast cancer Ala2466Val GCA to GTA | AAAATAAGATTAATGACAATGAGATTCATCAGTTTAACAAAAA CAACTCCAATCAAGCAGCAGCTGTAACTTTCACAAAGTGTGA AGAAGAACCTTTAGGTATTGTATGACAATTTGTGTG | 1093 |
| | CACACAAATTGTCATACAATACCTAAAGGTTCTTCTTCACACT TTGTGAAAGTTACAGCTGCTGCTTGATTGGAGTTGTTTTTGTT AAACTGATGAATCTCATTGTCATTAATCTTATTTT | 1094 |
| | TCAAGCAGCAGCTGTAA | 1095 |
| | TTACAGCTGCTGCTTGA | 1096 |
| Breast cancer Arg2520Term CGA to TGA | AGGCAACGCGTCTTTCCACAGCCAGGCAGTCTGTATCTTGCA AAAACATCCACTCTGCCTCGAATCTCTCTGAAAGCAGCAGTA GGAGGCCAAGTCCCCTCTGCGTGTCCTCATAAACAGG | 1097 |
| | CCTGTTTATGAGGACACGCAGAGGGGACTTGGCCTCCTACT GCTGCTTTCAGAGAGATTCGAGGCAGAGTGGATGTTTTGCA AGATACAGACTGCCTGGCTGTGGAAAGACGCGTTGCCT | 1098 |
| | CTCTGCCTCGAATCTCT | 1099 |
| | AGAGATTCGAGGCAGAG | 1100 |
| Breast cancer Gln2714Term CAA to TAA | ATTTCATTGAGCGCAAATATATCTGAAACTTCTAGCAATAAAA CTAGTAGTGCAGATACCCAAAAAGTGGCCATTATTGAACTTA CAGATGGGTGGTATGCTGTTAAGGCCCCAGTTAGATC | 1101 |
| | GATCTAACTGGGCCTTAACAGCATACCACCCATCTGTAAGTT CAATAATGGCCACTTTTTGGGTATCTGCACTACTAGTTTTATT GCTAGAAGTTTCAGATATATTTGCGCTCAATGAAAT | 1102 |
| | CAGATACCCAAAAAGTG | 1103 |
| | CACTTTTTGGGTATCTG | 1104 |
| Breast cancer Leu2776Term TTA to TGA | CAGAACTGGTGGGCTCTCCTGATGCCTGTACACCTCTTGAAG CCCCAGAATCTCTTATGTTAAAGGTAAATTAATTTGCACTCTT GGTAAAAATCAGTCATTGATTCAGTTAAATTCTAGA | 1105 |
| | TCTAGAATTTAACTGAATCAATGACTGATTTTTACCAAGAGTG CAAATTAATTTACCTTTAACATAAGAGATTCTGGGGCTTCAAG AGGTGTACAGGCATCAGGAGAGCCCACCAGTTCTG | 1106 |
| | TCTTATGTTAAAGATTT | 1107 |
| | AAATCTTTAACATAAGA | 1108 |
| Breast cancer Gln2893Term CAG to TAG | CCTTTTGTTTTCTTAGAAAACACAACAAAACCATATTTACCATC ACGTGCACTAACAAGACAGCAAGTTCGTGCTTTGCAAGATGG TGCAGAGCTTTATGAAGCAGTGAAGAATGCAGCAG | 1109 |
| | CTGCTGCATTCTTCACTGCTTCATAAAGCTCTGCACCATCTTG CAAAGCACGAACTTGCTGTCTTGTTAGTGCACGTGATGGTAA ATATGGTETTGTTGTGTTTTCTAAGAAAACAAAAGG | 1110 |
| | TAACAAGACAGCAAGTT | 1111 |
| | AACTTGCTGTCTTGTTA | 1112 |

TABLE 15-continued

BRCA2 Mutations and Genome-Correcting Oligos

| Clinical Phenotype & Mutation | Correcting Oligos | SEQ ID NO: |
|---|---|---|
| Breast cancer Ala2951Thr GCC to ACC | AATCACAGGCAAATGTTGAATGATAAGAAACAAGCTCAGATC CAGTTGGAAATTAGGAAGGCCATGGAATCTGCTGAACAAAAG GAACAAGGTTTATCAAGGGATGTCACAACCGTGTGGA | 1113 |
| | TCCACACGGTTGTGACATCCCTTGATAAACCTTGTTCCTTTTG TTCAGCAGATTCCATGGCCTTCCTAATTTCCAACTGGATCTGA GCTTGTTTCTTATCATTCAACATTVGCCTGTGATT | 1114 |
| | TTAGGAAGGCCATGGAA | 1115 |
| | TTCCATGGCCTTCCTAA | 1116 |
| Breast cancer Met3118Thr ATG to ACG | ACAATTTACTGGCAATAAAGTTTTGGATAGACCTTAATGAGGA CATTATTAAGCCTCATATGTTAATTGCTGCAAGCAACCTCCAG TGGCGACCAGAATCCAAATCAGGCCTTCTTACTTT | 1117 |
| | AAAGTAAGAAGGCCTGATTTGGATTCTGGTCGCCACTGGAG GTTGCTTGCAGCAATTAACATATGAGGCTTAATAATGTCCTCA TTAAGGTCTATCCAAAACTTTATTGCCAGTAAATTGT | 1118 |
| | GCCTCATATGTTAATTG | 1119 |
| | CAATTAACATATGAGGC | 1120 |
| Breast cancer Thr3401Met ACG to ATG | GACTGAAACGACGTTGTACTACATCTCTGATCAAAGAACAGG AGAGTTCCCAGGCCAGTACGGAAGAATGTGAGAAAAATAAGC AGGACACAATTACAACTAAAAAATATATCTAAGCATT | 1121 |
| | AATGCTTAGATATATTTTTTAGTTGTAATTGTGTCCTGCTTATT TTTCTCACATTCTTCCGTACTGGCCTGGGAACTCTCCTGTTCT TTGATCAGAGATGTAGTACAACGTCGTTTCAGTC | 1122 |
| | GGCCAGTACGGAAGAAT | 1123 |
| | ATTCTTCCGTACTGGCC | 1124 |
| Breast cancer Ile3412Val ATT to GTT | AAAGAACAGGAGAGTTCCCAGGCCAGTACGGAAGAATGTGA GAAAAATAAGCAGGACACAATTACAACTAAAAAATATATCTAA GCATTTGCAAAGGCGACAATAAATTATTGACGCTTAA | 1125 |
| | TTAAGCGTCAATAATTTATTGTCGCCTTTTGCAAATGCTTAGAT ATATTTTTTAGTTGTAATTGTGTCCTGCTTATTTTTCTCACATT CTTCCGTACTGGCCTGGGAACTCTCCTGTTCTTT | 1126 |
| | AGGACACAATTACAACT | 1127 |
| | AGTTGTAATTGTGTCCT | 1128 |

EXAMPLE 9

Cystic Fibrosis—CFTR

Cystic fibrosis is a lethal disease affecting approximately one in 2,500 live Caucasian births and is the most common autosomal recessive disease in Caucasians. Patents with this disease have reduced chloride ion permeability in the secretory and absorptive cells of organs with epithelial cell linings, including the airways, pancreas, intestine, sweat glands and male genital tract. This, in turn, reduces the transport of water across the epithelia. The lungs and the GI tract are the predominant organ systems affected in this disease and the pathology is characterized by blocking of the respiratory and GI tracts with viscous mucus. The chloride impermeability in affected tissues is due to mutations in a specific chloride channel, the cystic fibrosis transmembrane conductance regulator protein (CFTR), which prevents normal passage of chloride ions through the cell membrane (Welsh et al., Neuron, 8:821-829 (1992)). Damage to the lungs due to mucus blockage, frequent bacterial infections and inflammation is the primary cause of morbidity and mortality in CF patients and, although maintenance therapy has improved the quality of patients' lives, the median age at death is still only around 30 years. There is no effective treatment for the disease, and therapeutic research is focused on gene therapy using exogenous transgenes in viral vectors and/or activating the defective or other chloride channels in the cell membrane to normalize chloride permeability (Tizzano et al., J. Pediat., 120:337-349 (1992)). However, the death of a teenage patient treated with an adenovirus vector carrying an exogenous CFTR gene in clinical trials in the late 1990's has impacted this area of research.

The oligonucleotides of the invention for correction of the CFTR gene are attached as a table.

TABLE 16

CFTR Mutations and Genome-Correcting Oligos

| Clinical Phenotype & Mutation | Correcting Oligos | SEQ ID NO: |
|---|---|---|
| Cystic fibrosis Ala46Asp GCT to GAT | AAGGATACAGACAGCGCCTGGAATTGTCAGACATATACCAAA TCCCTTCTGTTGATTCTGCTGACAATCTATCTGAAAAATTGGA AAGGTATGTTCATGTACATTGTTTAGTTGAAGAGAG | 1129 |
| | CTCTCTTCAACTAAACAATGTACATGAACATACCTTTCCAATTT TTCAGATAGATTGTCAGCAGAATCAACAGAAGGGATTTGGTA TATGTCTGACAATTCCAGGCGCTGTCTGTATCCTT | 1130 |
| | TGATTCTGCTGACAATC | 1131 |
| | GATTGTCAGCAGAATCA | 1132 |
| Cystic fibrosis Ser50Tyr TCT to TAT | AGCGCCTGGAATTGTCAGACATATACCAAATCCCTTCTGTTG ATTCTGCTGACAATCTATCTGAAAAATTGGAAAGGTATGTTCA TGTACATTGTTTAGTTGAAGAGAGAAATTCATATTA | 1133 |
| | TAATATGAATTTCTCTCTTCAACTAAACAATGTACATGAACATA CCTTTCCAATTTTTCAGATAGATTGTCAGCAGAATCAACAGAA GGGATTTGGTATATGTCTGACAATTCCAGGCGCT | 1134 |
| | CAATCTATCTGAAAAAT | 1135 |
| | ATTTTTCAGATAGATTG | 1136 |
| Congenital absence of vas deferens Glu56Lys GAA-AAA | AGGACAACTAAAATATTTGCACATGCAACTTATTGGTCCCACT TTTTATTCTTTTGCAGAGAATGGGATAGAGAGCTGGCTTCAAA GAAAAATCCTAAACTCATTAATGCCCTTCGGCGAT | 1137 |
| | ATCGCCGAAGGGCATTAATGAGTTTAGGATTTTTTCTTGAAGC CAGCTCTCTATCCCATTCTCTGCAAAAGAATAAAAAGTGGGA CCAATAAGTVGCATGTGCAAATATTTAGTTGTCCT | 1138 |
| | TTTGCAGAGAATGGGAT | 1139 |
| | ATCCCATTCTCTGCAAA | 1140 |
| Cystic fibrosis Trp57Gly TGG to GGG | AGGACAACTAAAATATTTGCACATGCAACTTATTGGTCCCACT TTTTTATTCTTTTGCAGAGAATGGGATAGAGAGCTGGCTTCAAA GAAAAATCCTAAACTCATTAATGCCCTTCGGCGAT | 1141 |
| | ATCGCCGAAGGGCATTAATGAGTTTTAGGATTTTTTCTTGAAGC CAGCTCTCTATCCCATTCTCTGCAAAAGAATAAAAAGTGGGA CCAATAAGTTGCATGTGCAAATATTTTAGTTGTCCT | 1142 |
| | TTTGCAGAGAATGGGAT | 1143 |
| | ATCCCATTCTCTGCAAA | 1144 |
| Cystic fibrosis Trp57Term TGG to TGA | AACTAAAATATTTTGCACATGCAACTTATTGGTCCCACTTTTTAT TCTTTTGCAGAGAATGGGATAGAGAGCTGGCTTCAAAGAAAA ATCCTAAACTCATTAATGCCCTTCGGCGATGTTTT | 1145 |
| | AAAACATCGCCGAAGGGCATTAATGAGTTTAGGATTTTTCTTT GAAGCCAGCTCTCTATCCCATTCTCTGCAAAAGAATAAAAAGT GGGACCAATAAGTTGCATGTGCAAATATTTTAGTT | 1146 |
| | AGAGAATGGGATAGAGA | 1147 |
| | TCTCTATCCCATTCTCT | 1148 |
| Congenital absence of vas deferens Asp58Asn GAT to AAT | ACTAAAATATTTGCACATGCAACTTATTGGTCCCACTTTTTATT CTTTTGCAGAGAATGGGATAGAGAGCTGGCTTCAAAGAAAAA TCCTAAACTCATTAATGCCCTTCGGCGATGTTTT | 1149 |
| | AAAAACATCGCCGAAGGGCATTAATGAGTTTAGGATTTTTCTT TGAAGCCAGCTCTCTATCCCATTCTCTGCAAAAGAATAAAAAG TGGGACCAATAAGTTGCATGTGCAAATATTTTAGT | 1150 |
| | GAGAATGGGATAGAGAG | 1151 |
| | CTCTCTATCCCATTCTC | 1152 |
| Cystic fibrosis Gtu60Term | ATATTTGCACATGCAACTTATTGGTCCCACTTTTTATTCTTTTG CAGAGAATGGGATAGAGAGCTGGCTTCAAAGAAAAATCCTAA | 1153 |

TABLE 16-continued

CFTR Mutations and Genome-Correcting Oligos

| Clinical Phenotype & Mutation | Correcting Oligos | SEQ ID NO: |
|---|---|---|
| GAG to TAG | ACTCATTAATGCCCTTCGGCGATGTTTTTCTGGA | |
| | TCCAGAAAAAACATCGCCGAAGGGCATTAATGAGTTTAGGAT TTTTCTTTGAAGCCAGCTCTCTATCCCATTCTCTGCAAAAGAA TAAAAAGTGGGACCAATAAGTTGCATGTGCAAATAT | 1154 |
| | GGGATAGAGAGCTGGCT | 1155 |
| | AGCCAGCTCTCTATCCC | 1156 |
| Cystic fibrosis Pro67Leu CCT to CTT | GGTCCCACTTTTTATTCTTTTGCAGAGAATGGGATAGAGAGC TGGCTTCAAAGAAAAATCCTAAACTCATTAATGCCCCTTCGGC GATGTTTTTTCTGGAGATTTATGTTCTATGGAATCTT | 1157 |
| | AAGATTCCATAGAACATAAATCTCCAGAAAAAACATCGCCGAA GGGCATTAATGAGTTTAGGATTTTTCTTTGAAGCCAGCTCTCT ATCCCATTCTCTGCAAAAGAATAAAAAGTGGGACC | 1158 |
| | GAAAAATCCTAAACTCA | 1159 |
| | TGAGTTTAGGAATTTTC | 1160 |
| Cystic fibrosis Arg74Trp CGG to TGG | TGCAGAGAATGGGATAGAGAGCTGGCTTCAAAGAAAAATCCT AAACTCATTAATGCCCTTCGGCGATGTTTTTTCTGGAGATTTA TGTTCTATGGAATCTTTTTATATTTAGGGGTAAGGA | 1161 |
| | TCCTTACCCCTAAATATAAAAAGATTCCATAGAACATAAATCT CCAGAAAAAACATCGCCGAAGGGCATTAATGAGTTTAGGATT TTTCTTTGAAGCCAGCTCTCTATCCCATTCTCTGCA | 1162 |
| | ATGCCCTTCGGCGATGT | 1163 |
| | ACATCGCCGAAGGGCAT | 1164 |
| Congenital absence of vas deferens ARG75GLN CGA to CAA | GAGAATGGGATAGAGAGCTGGCTTCAAAGAAAAATCCTAAAC TCATTAATGCCCTTCGGCGATGTTTTTTCTGGAGATTTTATGTT CTATGGAATCTTTTTATATTTAGGGGTAAGGATCTC | 1165 |
| | GAGATCCTTACCCCTAAATATAAAAAGATTCCATAGAACATAA ATCTCCAGAAAAAACATCGCCGAAGGGCATTAATGAGTTTAG GATTTTTTCTTTGAAGCCAGCTCTCTATCCCATTCTC | 1166 |
| | CCTTCGGCGATGTTTTT | 1167 |
| | AAAAACATCGCCGAAGG | 1168 |
| Cystic fibrosis Arg75Leu CGA to CTA | GAGAATGGGATAGAGAGCTGGCTTCAAAGAAAAATCCTAAAC TCATTAATGCCCTTCGGCGATGTTTTTTCTGGAGATTTTATGTT CTATGGAATCTTTTTATATTAGGGGTAAGGATCTC | 1169 |
| | GAGATCCTTACCCCTAAATATAAAAAGATTCCATAGAACATAA ATCTCCAGAAAAAACATCGCCGAAGGGCATTAATGAGTTTAG GATTTTTTCTTTGAAGCCAGCTCTCTATCCCATTCTC | 1170 |
| | CCTTCGGCGATGTTTTT | 1171 |
| | AAAAACATCGCCGAAGG | 1172 |
| Cystic fibrosis Arg75Term CGA to TGA | AGAGAATGGGATAGAGAGCTGGCTTCAAAGAAAAATCCTAAA CTCATTAATGCCCTTCGGCGATGTTTTTTCTGGAGATTTATGT TCTATGGAATCTTTTTATATTTAGGGGTAAGGATCT | 1173 |
| | AGATCCTTACCCCTAAATATAAAAAGATTCCATAGAACATAAA TCTCCAGAAAAAACATCGCCGAAGGGCATTAATGAGTTTTAGG ATTTTTTCTTTGAAGCCAGCTCTCTATCCCATTCTCT | 1174 |
| | CCCTTCGGCGATGTTTT | 1175 |
| | AAAACATCGCCGAAGGG | 1176 |
| Cystic fibrosis Gly85Glu GGA to GAA | ATTAAATCCTAAACTCATTAATGCCCTTCGGCGATGTTTTTCTG GAGATTTATGTTCTATGGAATCTTTTTATATTTAGGGGTAAGG ATCTCATTTGTACATTCATATGTATCACATAACT | 1177 |

TABLE 16-continued

CFTR Mutations and Genome-Correcting Oligos

| Clinical Phenotype & Mutation | Correcting Oligos | SEQ ID NO: |
|---|---|---|
| | AGTTATGTGATACATAATGAATGTACAAATGAGATCCTTACCC CTAAATATAAAAAGATTCCATAGAACATAAATCTCCAGAAAAA ACATCGCCGAAGGGCATTAATGAGTTTAGGATTTT | 1178 |
| | GTTCTATGGAATCTTTT | 1179 |
| | AAAAGATTCCATAGAAC | 1180 |
| Cystic fibrosis Gly85Val GGA to GTA | AAAATCCTAAACTCATTAATGCCCTTCGGCGATGTTTTTTCTG GAGATTTATGTTCTATGGAATCTTTTTATATTTAGGGGTAAGG ATCTCATTTGTACATTCATTATGTATCACATAACT | 1181 |
| | AGTTATGTGATACATAATGAATGTACAAATGAGATCCTTTACCC CTAAATATAAAAAGATTCCATAGAACATAAATCTCCAGAAAAA ACATCGCCGAAGGGCATTAATGAGTTTAGGATTTT | 1182 |
| | GTTCTATGGAATCTTTT | 1183 |
| | AAAAGATTCCATAGAAC | 1184 |
| Cystic fibrosis Leu88Ser TTA to TCA | AACTCATTAATGCCCTTCGGCGATGTTTTTTCTGGAGATTTAT GTTCTATGGAATCTTTTTTATATTTAGGGGTAAGGATCTCATTT GTACATTCATTATGTATCACATAACTATATGCATT | 1185 |
| | AATGCATATAGTTATGTGATACATAATGAATGTACAAATGAGA TCCTTACCCCTAAATATAAAAAGATTCCATAGAACATAAATCT CCAGAAAAAACATCGCCGAAGGGCATTAATGAGTT | 1186 |
| | AATCTTTTTATATTTAG | 1187 |
| | CTAAATATAAAAAGATT | 1188 |
| Cystic fibrosis Phe87Leu TTT to CTT | CCTAAACTCATTAATGCCCTTCGGCGATGTTTTTTCTGGAGAT TTATGTTCTATGGAATCTTTTTATATTTAGGGGTAAGGATCTC ATTTGTACATTCATTATGTATCACATAACTATATG | 1189 |
| | CATATAGTTATGTGATACATAATGAATGTACAAATGAGATCCT TACCCCTAAATATAAAAAGATTCCATAGAACATAAATCTCCAG AAAAAACATCGCCGAAGGGCATTAATGAGTTTAGG | 1190 |
| | ATGGAATCTTTTTATAT | 1191 |
| | ATATAAAAAGATTCCAT | 1192 |
| Cystic fibrosis Leu88Term TTA to TGA | AACTCATTAATGCCCHCGGCGATGTTTTTTCTGGAGATTTAT GTTCTATGGAATCTTTTTATATTTAGGGGTAAGGATCTCATTT GTACATTCATTATGTATCACATAACTATATGCATT | 1193 |
| | AATGCATATAGTTATGTGATACATAATGAATGTACAAATGAGA TCCTTACCCCTAAATATAAAAAGATTCCATAGAACATAAATCT CCAGAAAAAACATCGCCGAAGGGCATTAATGAGTT | 1194 |
| | AATCTTTTTATATTTAG | 1195 |
| | CTAAATATAAAAAGATT | 1196 |
| Cystic fibrosis Leu88Term TTA to TAA | AACTCATTAATGCCCTTCGGCGATGTTTTTTCTGGAGATTTAT GTTCTATGGAATCTTTTTATATTTAGGGGTAAGGATCTCATTT GTACATTCATTATGTATCACATAACTATATGCATT | 1197 |
| | AATGCATATAGTTATGTGATACATAATGAATGTACAAATGAGA TCCTTACCCCTAAATATAAAAAGATTCCATAGAACATAGAATCT CCAGAAAAAACATCGCCGAAGGGCATTAATGAGTT | 1198 |
| | AATCTTTTTATATTTAG | 1199 |
| | CTAAATATAAAAAGATT | 1200 |
| Cystic fibrosis Gly91Arg GGG to AGG | AATGCCCTTCGGCGATGTTTTTTCTGGAGATTTATGTTCTATG GAATCTTTTTATATTTAGGGGTAAGGATCTCATTTGTACATTC ATTATGTATCACATAACTATATGCATTTTTGTGAT | 1201 |
| | ATCACAAAAATGCATATAGTTATGTGATACATAATGAATGTAC AAATGAGATCCTTACCCCTAAATATAAAAAGATTCCATAGAAC | 1202 |

TABLE 16-continued

CFTR Mutations and Genome-Correcting Oligos

| Clinical Phenotype & Mutation | Correcting Oligos | SEQ ID NO: |
|---|---|---|
| | ATAAATCTCCAGAAAAAACATCGCCGAAGGGCATT | |
| | TATATTTAGGGGTAAGG | 1203 |
| | CCTTACCCCTAAATATA | 1204 |
| Cystic fibrosis Gln98Arg CAG to CGG | AATAAATGAAATTTAATTTCTCTGGTTTTCCCCTTGTGTAGGAA GTCACCAAAGCAGTACAGCCTCTCTTACTGGGAAGAATCATA GCTTCCTATGACCCGGATAACAAGGAGGAACGCTC | 1205 |
| | GAGCGTTCCTCCTTGTTATCCGGGTCATAGGAAGCTATGATT CTTCCCAGTAAGAGAGGCTGTACTGCTTTGGTGACTTCCTAC AAAAGGGGAAAAACAGAGAAATTAAATTTCATTTATT | 1206 |
| | AGCAGTACAGCCTCTCT | 1207 |
| | AGAGAGGCTGTACTGCT | 1208 |
| Cystic fibrosis Gln98Term CAG-TAG | AAATAAATGAAATTTAATTTCTCTGTTTTTCCCCTTTTGTAGGA AGTCACCAAAGCAGTACAGCCTCTCTTACTGGGAAGAATCAT AGCTTCCTATGACCCGGATAACAAGGAGGAACGCT | 1209 |
| | AGCGTTCCTCCTTGTTATCCGGGTCATAGGAAGCTATGATTC TTCCCAGTAAGAGAGGCTGTACTGCTTTGGTGACTTCCTACA AAAGGGGAAAAACAGAGAAATTAAATTTCATTTATTT | 1210 |
| | AAGCAGTACCAGCCTCTC | 1211 |
| | GAGAGGCTGTACTGCTT | 1212 |
| Cystic fibrosis Ser108Phe TCC to TTC | CCCTTTTGTAGGAAGTCACCAAAGCAGTACAGCCTCTCTTAC TGGGAAGAATCATAGCTTCCTATGACCCGGATAACAAGGAGG AACGCTCTATCGCGATTTATCTAGGCATAGGCTTATG | 1213 |
| | CATAAGCCTATGCCTAGATAAATCGCGATAGAGCGTTCCTCC TTGTTATCCGGGTCATAGGAAGCTATGATTCTTCCCAGTAAG AGAGGCTGTACTGCTTTGGTGACTTCCTACAAAAGGG | 1214 |
| | CATAGCTTCCTATGACC | 1215 |
| | GGTCATAGGAAGCTATG | 1216 |
| Cystic fibrosis Tyr109Cys TAT to TGT | TTTTGTAGGAAGTCACCAAAGCAGTACAGCCTCTCTTACTGG GAAGAATCATAGCTTCCTATGACCCGGATAACAAGGAGGAAC GCTCTATCGCGATTATCTAGGCATAGGCTTATGCCT | 1217 |
| | AGGCATAAGCCTATGCCTAGATAAATCGCGATAGAGCGTTCC TCCTTGTTATCCGGGTCATAGGAAGCTATGATTCTTCCCAGT AAGAGAGGCTGTACTGCTTTGGTGACTTCCTACAAAA | 1218 |
| | AGCTTCCTATGACCCGG | 1219 |
| | CCGGGTCATAGGAAGCT | 1220 |
| Cystic fibrosis Asp110His GAC to CAC | TTGTAGGAAGTCACCAAAGCAGTACAGCCTCTCTTACTGGGA AGAATCATAGCTTCCTATGACCCGGATAACAAGGAGGAACGC TCTATCGCGATTTATCTAGGCATAGGCTTATGCCTTC | 1221 |
| | GAAGGCATAAGCCTATGCCTAGATAAATCGCGATAGAGCGTT CCTCCYTGTTATCCGGGTCATAGGAAGCTATGATTCTTCCCA GTAAGAGAGGCTGTACTGCTTTGGTGACTTCCTACAA | 1222 |
| | CTTCCTATGACCCGGAT | 1223 |
| | ATCCGGGTCATAGGAAG | 1224 |
| Congenital absence of vas deferens Pro111Leu CCG to CTG | AGGAAGTCACCAAAGCAGTACAGCCTCTCTTACTGGGAAGAA TCATAGCTTCCTATGACCCGGATAACAAGGAGGAACGCTCTA TCGCGATTTATCTAGGCATAGGCTTATGCCTTCTTCT | 1225 |
| | AAGAGAAGGCATAAGCCTATGCCTAGATAAATCGCGATAGAG CGTTCCTCCTTGTTATCCGGGTCATAGGAAGCTATGATTCTT CCCAGTAAGAGAGGCTGTACTGCTTTGGTGACTTCCT | 1226 |

TABLE 16-continued

CFTR Mutations and Genome-Correcting Oligos

| Clinical Phenotype & Mutation | Correcting Oligos | SEQ ID NO: |
|---|---|---|
| | CTATGACCCGGATAACA | 1227 |
| | TGTTATCCGGGTCATAG | 1228 |
| Cystic fibrosis Arg117Cys CGC to TGC | GTACAGCCTCTCTTACTGGGAAGAATCATAGCTTCCTATGAC CCGGATAACAAGGAGGAACGCTCTATCGCGATTTATCTAGGC ATAGGCTTATGCCTTCTCTTTATTGTGAGGACACTGC | 1229 |
| | GCAGTGTCCTCACAATAAAGAGAAGGCATAAGCCTATGCCTA GATAAATCGCGATAGAGCGTTCCTCCTTGTTATCCGGGTCAT AGGAAGCTATGATTCTTCCCAGTAAGAGAGGCTGTAC | 1230 |
| | AGGAGGAACGCTCTATC | 1231 |
| | GATAGAGCGTTCCTCCT | 1232 |
| Cystic fibrosis Arg117His CGC to CAC | TACAGCCTCTCTTACTGGGAAGAATCATAGCTTCCTATGACC CGGATAACAAGGAGGAACGCTCTATCGCGATTTATCTAGGCA TAGGCTTATGCCTTCTCTTTATTGTGAGGACACTGCT | 1233 |
| | AGCAGTGTCCTCACAATAAAGAGAAGGCATAAGCCTATGCCT AGATAAATCGCGATAGAGCGTTCCTCCTTGTTATCCGGGTCA TAGGAAGCTATGATTCTTCCCAGTAAGAGAGGCTGTA | 1234 |
| | GGAGGAACGCTCTATCG | 1235 |
| | CGATAGAGCGTTCCTCC | 1236 |
| Cystic fibrosis Arg117Leu CGC to CTC | TACAGCCTCTCGTACTGGGAAGAATCATAGCTTCCTATGACC CGGATAACAAGGAGGAACGCTCTATCGCGATTTATCTAGGCA TAGGCTTATGCCTTCTCTTTATTGTGAGGACACTGCT | 1237 |
| | AGCAGTGTCCTCACAATAAAGAGAAGGCATAAGCCTATGCCT AGATAAATCGCGATAGAGCGTTCCTCCTTGTTATCCGGGTCA TAGGAAGCTATGATTCTTCCCAGTAAGAGAGGCTGTA | 1238 |
| | GGAGGAACGCTCTATCG | 1239 |
| | CGATAGAGCGTTCCTCC | 1240 |
| Cystic fibrosis Arg117Pro CGC to CCC | TACAGCCTCTCTTTACTGGGAAGAATCATAGCTTCCTATGACC CGGATAACAAGGAGGAACGCTCTATCGCGATTTATCTAGGCA TAGGCTTATGCCTTCTCTTTATTGTGAGGACACTGCT | 1241 |
| | AGCAGTGTCCTCACAATAAAGAGAAGGCATAAGCCTATGCCT AGATAAATCGCGATAGAGCGTTCCTCCTTGTTATCCGGGTCA TAGGAAGCTATGATTCTTCCCAGTAAGAGAGGCTGTA | 1242 |
| | GGAGGAACGCTCTATCG | 1243 |
| | CGATAGAGCGTTCCTCC | 1244 |
| Cystic fibrosis Ala120Thr GCG-ACG | CTCTTACTGGGAAGAATCATAGCTTCCTATGACCCGGATAAC AAGGAGGAACGCTCTATCGCGATTTATCTAGGCATAGGCTTA TGCCTTCTCTTTATTGTGAGGACACTGCTCCTACACC | 1245 |
| | GGTGTAGGAGCAGTGTCCTCACAATAAAGAGAAGGCATAAG CCTATGCCTAGATAAATCGCGATAGAGCGTTCCTCCTTGTTA TCCGGGTCATAGGAAGCTATGATTCTTCCCAGTAAGAG | 1246 |
| | GCTCTATCGCGATTTAT | 1247 |
| | ATAAATCGCGATAGAGC | 1248 |
| Cystic fibrosis Tyr122Term TAT to TAA | GGGAAGAATCATAGCTTCCTATGACCCGGATAACAAGGAGGA ACGCTCTATCGCGATTTATCTAGGCATAGGCTTATGCCTTCT CTTTATTGTGAGGACACTGCTCCTACACCCAGCCATT | 1249 |
| | AATGGCTGGGTGTAGGAGCAGTGTCCTCACAATAAAGAGAA GGCATAAGCCTATGCCTAGATAAATCGCGATAGAGCGTTTCCT CCTTGTTATCCGGGTCATAGGAAGCTATGATTCTTCCC | 1250 |

TABLE 16-continued

CFTR Mutations and Genome-Correcting Oligos

| Clinical Phenotype & Mutation | Correcting Oligos | SEQ ID NO: |
|---|---|---|
| | GCGATTTATCTAGGCAT | 1251 |
| | ATGCCTAGATAAATCGC | 1252 |
| Cystic fibrosis Gly126Asp GGC-GAC | TAGCTTCCTATGACCCGGATAACAAGGAGGAACGCTCTATCG CGATTTATCTAGGCATAGGCTTATGCCTTCTCTTTATTGTGAG GACACTGCTCCTACACCCAGCCATTTTTGGCCTTCA | 1253 |
| | TGAAGGCCAAAAATGGCTGGGTGTAGGAGCAGTGTCCTCAC AATAAAGAGAAGGCATAAGCCTATGCCTAGATAAATCGCGAT AGAGCGTTCCTCCTTGTTATCCGGGTCATAGGAAGCTA | 1254 |
| | AGGCATAGGCTTATGCC | 1255 |
| | GGCATAAGCCTATGCCT | 1256 |
| Cystic fibrosis Hist139Arg CAC to CGC | TCGCGATTTATCTAGGCATAGGCTTATGCCTTCTCTTTATTGT GAGGACACTGCTCCTACACCCAGCCATTTTTGGCCTTCATCA CATTGGAATGCAGATGAGAATAGCTATGTTTAGTTT | 1257 |
| | AAACTAAACATAGCTATTCTCATCTGCATTCCAATGTGATGAA GGCCAAAAATGGCTGGGTGTAGGAGCAGTGTCCTCACAATA AAGAGAAGGCATAAGCCTATGCCTAGATAAATCGCGA | 1258 |
| | GCTCCTACACCCAGCCA | 1259 |
| | TGGCTGGGTGTAGGAGC | 1260 |
| Cystic fibrosis Ala141Asp GCC to GAC | TTTATCTAGGCATAGGCTTATGCCTTCTCTTTATTGTGAGGAC ACTGCTCCTACACCCAGCCATTTTTGGCCTTCATCACATTGG AATGCAGATGAGAATAGCTATGTTTAGTTTGATTTA | 1261 |
| | TAAATCAAACTAAACATAGCTATTCTCATCTGCATTCCAATGT GATGAAGGCCAAAAATGGCTGGGTGTAGGAGCAGTGTCCTC ACAATAAAGAGAAGGCATAAGCCTATGCCTAGATAAA | 1262 |
| | ACACCCAGCCATTTTTG | 1263 |
| | CAAAAATGGCTGGGTGT | 1264 |
| Cystic fibrosis Ile148Thr ATT to ACT | GCCTTCTCTTTATTGTGAGGACACTGCTCCTACACCCAGCCA TTTTTGGCCTTCATCACATTGGAATGCAGATGAGAATAGCTAT GTTAGTTTGATTTATAAGAAGGTAATACTTCCTTG | 1265 |
| | CAAGGAAGTATTACCTTCTTATAAATCAAACTAAACATAGCTA TTCTCATCTGCATTCCAATGTGATGAAGGCCAAAAATGGCTG GGTGTAGGAGCAGTGTCCTCACAATAAAGAGAAGGC | 1266 |
| | TCATCACATTGGAATGC | 1267 |
| | GCATTCCAATGTGATGA | 1268 |
| Cystic fibrosis Gly149Arg GGA to AGA | CTTCTCGTTATTGTGAGGACACTGCTCCTACACCCAGCCATTT TTGGCCTTCATCACATTGGAATGCAGATGAGAATAGCTATGTT TAGTTTGATTATAAGAAGGTAATACTTCCTTGCA | 1269 |
| | TGCAAGGAAGTATTACCTTCTTATAAATCAAACTAAACATAGC TATTCTCATCTGCATTCCAATGTGATGAAGGCCAAAAATGGCT GGGTGTAGGAGCAGTGTCCTCACAATAAAGAGAAG | 1270 |
| | ATCACATTGGAATGCAG | 1271 |
| | CTGCATTCCAATGTGAT | 1272 |
| Cystic fibrosis Gln1511Term CAG to TAG | TTTATTGTGAGGACACTGCTCCTACACCCAGCCATTTTTGGC CTTCATCACATTGGAATGCAGATGAGAATAGCTATGGTTAGTT TGATTTATAAGAAGGTAATACTTCCTTGCACAGGCC | 1273 |
| | GGCCTGTGCAAGGAAGTATTACCTTCTTATAAATCAAACTAAA CATAGCTATTCTCATCTGCATTCCAATGTGATGAAGGCCAAAA ATGGCTGGGTGTAGGAGCAGTGTCCTCACAATAAA | 1274 |

TABLE 16-continued

CFTR Mutations and Genome-Correcting Oligos

| Clinical Phenotype & Mutation | Correcting Oligos | SEQ ID NO: |
|---|---|---|
| | TTGGAATGCAGATGAGA | 1275 |
| | TCTCATCTGCATTCCAA | 1276 |
| Cystic fibrosis Lys166Glu AAG-GAG | AATATATTTGTATTTTGTTTGTTGAAATTATCTAACTTTCCATTT TTCTTTTAGACTTTAAAGCTGTCAAGCCGTGTTCTAGATAAAA TAAGTATTGGACAACTTGTTAGTCTCCTTTCCA | 1277 |
| | TGGAAAGGAGACTAACAAGTTGTCCAATACTTATTTTATCTAG AACACGGCTTGACAGCTTTAAAGTCTAAAAGAAAAATGGAAA GTTAGATAATTTCAACAAACAAAATACAAATATATT | 1278 |
| | AGACTTTAAAGCTGTCA | 1279 |
| | TGACAGCTTTAAAGTCT | 1280 |
| Cystic fibrosis Ile175Val ATA-GTA | TTATCTAACTTTCCATTTTTCTTTTAGACTTTAAAGCTGTCAAG CCGTGTTCTAGATAAAATAAGTATTGGACAACTTGTTAGTCTC CTTTCCAACAACCTGAACAAATTTGATGAAGTAT | 1281 |
| | ATACTTCATCAAATTTGTTCAGGTTGTTGGAAAGGAGACTAAC AAGTTGTCCAATACTTATTTTATCTAGAACACGGCTTGACAGC TTTAAAGTCTAAAAGAAAAATGGAAAGTTAGATAA | 1282 |
| | TAGATAAAATAAGTATT | 1283 |
| | AATACTTATTTTATCTA | 1284 |
| Cystic fibrosis Gly178Arg GGA to AGA | TTTCCATTTTTCTTTTAGACTTTAAAGCTGTCAAGCCGTGTTCT AGATAAAATAAGTATTGGACAACTTGTTAGTCTCCTTTCCAAC AACCTGAACAAATTTGATGAAGTATGTACCTATT | 1285 |
| | AATAGGTACATACTTCATCAAATTTGTTCAGGTTGTTGGAAAG GAGACTAACAAGTTGTCCAATACTTATTTTATCTAGAACACGG CTTGACAGCTTTAAAGTCTAAAAGAAAAATGGAAA | 1286 |
| | TAAGTATTGGACAACTT | 1287 |
| | AAGTTGTCCAATACTTA | 1288 |
| Cystic fibrosis His199Gln CAT to CAG | AAGATACAATGACACCTGTTTTTGCTGTGCTTTTATTTTCCAG GGACTTGCATTGGCACATTTCGTGTGGATCGCTCCTTTGCAA GTGGCACTCCTCATGGGGCTAATCTGGGAGTTGTTA | 1289 |
| | TAACAACTCCCAGATTAGCCCCATGAGGAGTGCCACTTGCAA AGGAGCGATCCACACGAAATGTGCCAATGCAAGTCCCTGGA AAATAAAAGCACAGCAAAAACAGGTGTCATTGTATCTT | 1290 |
| | TTGGCACATTTCGTGTG | 1291 |
| | CACACGAAATGTGCCAA | 1292 |
| Cystic fibrosis His199Tyr CAT to TAT | GGAAGATACAATGACACCTGTTTTTGCTGTGCTTTTATTTTCC AGGGACTTGCATTGGCACATTTCGTGTGGATCGCTCCTTTGC AAGTGGCACTCCTCATGGGGCTAATCTGGGAGTTGT | 1293 |
| | ACAACTCCCAGATTAGCCCCATGAGGAGTGCCACTTGCAAAG GAGCGATCCACACGAAATGTGCCAATGCAAGTCCCTGGAAA ATAAAAGCACAGCAAAAACAGGTGTCATTGTATCTTCC | 1294 |
| | CATTGGCACATTTCGTG | 1295 |
| | CACGAAATGTGCCAATG | 1296 |
| Cystic fibrosis Pro205Ser CCT to TCT | TGTTTTTGCTGTGCTTTATTTTCCAGGGACTTGCATTGGCAC ATTTCGTGTGGATCGCTCCTTTGCAAGTGGCACTCCTCATGG GGCTAATCTGGGAGTTGTTACAGGCGTCTGCCTTCT | 1297 |
| | AGAAGGCAGACGCCTGTAACAACTCCCAGATTAGCCCCATG AGGAGTGCCACTTGCAAGGGAGCGATCCACACGAAATGTGC CAATGCAAGTCCCTGGAAAATAAAAGCACAGCAAAAACA | 1298 |

TABLE 16-continued

CFTR Mutations and Genome-Correcting Oligos

| Clinical Phenotype & Mutation | Correcting Oligos | SEQ ID NO: |
|---|---|---|
| | GGATCGCTCCTTTGCAA | 1299 |
| | TTGCAAAGGAGCGATCC | 1300 |
| Cystic fibrosis Leu206Trp TTG to TGG | TTTGCTGTGCTTTATTTTCCAGGGACTTGCATTGGCACATTT CGTGTGGATCGCTCCTTTGCAAGTGGCACTCCTCATGGGGC TAATCTGGGAGTTGTTACAGGCGTCTGCCTTCTGTGG | 1301 |
| | CCACAGAAGGCAGACGCCTGTAACAACTCCCAGATTAGCCC CATGAGGAGTGCCACTTGCAAAGGAGCGATCCACACGAAAT GTGCCAATGCAAGTCCCTGGAAAATAAAAGCACAGCAAA | 1302 |
| | CGCTCCTTTGCAAGTGG | 1303 |
| | CCACTTGCAAAGGAGCG | 1304 |
| Cystic fibrosis Gln220Term CAG to TAG | TTCGTGTGGATCGCTCCTTTGCAAGTGGCACTCCTCATGGG GCTAATCTGGGAGTTGTTACAGGCGTCTGCCTTCTGTGGACT TGGTTTCCTGATAGTCCTTGCCCTTTTTCAGGCTGGGC | 1305 |
| | GCCCAGCCTGAAAAAGGGCAAGGACTATCAGGAAACCAAGT CCACAGAAGGCAGACGCCTGTAACAACTCCCAGATTAGCCC CATGAGGAGTGCCACTTGCAAAGGAGCGATCCACACGAA | 1306 |
| | AGTTGTTACAGGCGTCT | 1307 |
| | AGACGCCTGTAACAACT | 1308 |
| Cystic fibrosis Cys225Arg TGT-CGT | CCTTTGCAAGTGGCACTCCTCATGGGGCTAATCTGGGAGTT GTTACAGGCGTCTGCCTTCTGTGGACTTGGTTTCCTGATAGT CCTTGCCCTTTTTCAGGCTGGGCTAGGGAGAATGATGA | 1309 |
| | TCATCATTCTCCCTAGCCCAGCCTGAAAAAGGGCAAGGACTA TCAGGAAACCAAGTCCACAGAAGGCAGACGCCTGTAACAAC TCCCAGATTAGCCCCATGAGGAGTGCCACTTGCAAAGG | 1310 |
| | CTGCCTTCTGTGGACTT | 1311 |
| | AAGTCCACAGAAGGCAG | 1312 |
| Cystic fibrosis Val232Asp GTC to GAC | TGGGGCTAATCTGGGAGTTGTTACAGGCGTCTGCCTTCTGT GGACTTGGTTTCCTGATAGTCCTTGCCCTTTTTCAGGCTGGG CTAGGGAGAATGATGATGAAGTACAGGTAGCAACCTAT | 1313 |
| | ATAGGTTGCTACCTGTACTTCATCATCATTCTCCCTAGCCCA GCCTGAAAAAGGGCAAGGACTATCAGGAAACCAAGTCCACA GAAGGCAGACGCCTGTAACAACTCCCAGATTAGCCCCA | 1314 |
| | CCTGATAGTCCTTGCCC | 1315 |
| | GGGCAAGGACTATCAGG | 1316 |
| Cystic fibrosis Gly239Arg GGG to AGG | GTTACAGGCGTCTGCCTTCTGTGGACTTGGTTTCCTGATAGT CCTTGCCCTTTTTCAGGCTGGGCTAGGGAGAATGATGATGAA GTACAGGTAGCAACCTATTTTTCATAACTTGAAAGTTT | 1317 |
| | AAACTTTCAAGTTATGAAAATAGGTTGCTACCTGTACTTCATC ATCATTCTCCCTAGCCCAGCCTGAAAATTAGGGCAAGGACTATC AGGAAACCAAGTCCACAGAAGGCAGACGCCTGTAAC | 1318 |
| | TTTCAGGCTGGGCTAGG | 1319 |
| | CCTAGCCCAGCCTGAAA | 1320 |

EXAMPLE 10

Cyclin-dependent Kinase Inhibitor 2A—CDKN2A

The human CDKN2A gene was also designated MTS-1 for multiple tumor suppressor-1 and has been implicated in multiple cancers including, for example, malignant melanoma. Malignant melanoma is a cutaneous neoplasm of melanocytes. Melanomas generally have features of asymmetry, irregular border, variegated color, and diameter greater than 6 mm. The precise cause of melanoma is unknown, but sunlight and heredity are risk factors. Melanoma has been increasing during the past few decades.

The CDKN2A gene has been found to be homozygously deleted at high frequency in cell lines derived from tumors of lung, breast, brain, bone, skin, bladder, kidney, ovary, and lymphocyte. Melanoma cell lines carried at least one copy of CDKN2A in combination with a deleted allele. Melanoma cell lines that carried at least 1 copy of CDKN2A frequently showed nonsense, missense, or frameshift mutations in the gene. Thus, CDKN2A may rival p53 (see Example 5) in the universality of its involvement in tumorigenesis. The attached table discloses the correcting oligonucleotide base sequences for the CDKN2A oligonucleotides of the invention.

TABLE 17

CDKN2A Mutations and Genome-Correcting Oligos

| Clinical Phenotype & | Correcting Oligos | SEQ ID NO: |
|---|---|---|
| Melanoma Trp15Term TGG→TAG | GGGCGGCGGGGAGCAGCATGGAGCCGGCGGCGGGGAGCAG CATGGAGCCTTCGGCTGACTGCTGGCCACGGCCGCGGCCC GGGGTCGGGTAGAGGAGGTGCGGGCGCTGCTGGAGGCGGG | 1321 |
| | CCCGCCTCCAGCAGCGCCCGCACCTCCTCTACCCGACCCG GGCCGCGGCCGTGGCCAGCCAGTCAGCCGAAGGCTCCATGC TGCTCCCCGCCGCCGGCTCCATGCTGCTCCCCGCCGCCC | 1322 |
| | GGCTGACTGGCTGGCCA | 1323 |
| | TGGCCAGCCAGTCAGCC | 1324 |
| Melanoma Leu16Pro CTG→CCG | CGGCGGGGAGCAGCATGGAGCCGGCGGCGGGGAGCAGCAT GGAGCCTTCGGCTGACTGGCTGGCCACGGCCGCGGCCCGG GGTCGGGTAGAGGAGGTGCGGGCGCTGCTGGAGGCGGGG C | 1325 |
| | GCCCCGCCTCCAGCAGCGCCCGCACCTCCTCTACCGACC CCGGGCCGCGGCCGTGGCCAGCCAGTCAGCCGAAGGCTCC ATGCTGCTCCCCGCCGCCGGCTCCATGCTGCTCCCCGCCG | 1326 |
| | TGACTGGCTGGCCACGG | 1327 |
| | CCGTGGCCAGCCAGTCA | 1328 |
| Melanoma Gly23Asp CTG→CCG | CGGCGGCGGGGAGCAGCATGGAGCCTTCGGCTGACTGGCTG GCCACGGCCGCGGCCCGGGGTCGGGTAGAGGAGGTGCGGG CGCTGCTGGAGGCGGGGCGCTGCCCAACGCACCGAATAG | 1329 |
| | CTATTCGGTGCGTTGGGCAGCGCCCCGCCTCCAGCAGCGC CCGCACCTCCTCTACCCGACCCCGGGCCGCGGCCGTGGCCA GCCAGTCAGCCGAAGGCTCCATGCTGCTCCCCGCCGCCG | 1330 |
| | GGCCCGGGGTCGGGTAG | 1331 |
| | CTACCCGACCCCGGGCC | 1332 |
| Melanoma Arg24Pro CGG→CCG | CGGCGGGGAGCAGCATGGAGCCTTCGGCTGACTGGCTGGCC ACGGCCGCGGCCCGGGGTCGGGTAGAGGAGGTGCGGGCGC TGCTGGAGGCGGGGCGCTGCCCAACGCACCGAATAGTTA | 1333 |
| | TAACTATTCGGTGCGTTGGGCAGCGCCCCGCCTCCAGCAGC GCCCGCACCTCCTCTACCCGACCCCGGGCCGCGGCCGTGGC CAGCCAGTCAGCCGAAGGCTCCATGCTGCTCCCCGCCG | 1334 |
| | CCGGGGTCGGGTAGAGG | 1335 |
| | CCTCTACCCGACCCCGG | 1336 |
| Melanoma Leu32Pro CTG→CCG | CGGCTGACTGGCTGGCCACGGCCGCGGCCCGGGGTCGGGT AGAGGAGGTGCGGGCGCTGCTGGAGGCGGGGCGCTGCCC AACGCACCGAATAGTTACGGTCGGAGGCCGATCCAGGTGGG | 1337 |
| | CCCACCTGGATCGGCCTCCGACCGTAACTATTCGGTGCGTTG GGCAGCGCCCCGCCTCCAGCAGCGCCCGCACCTCCTCTAC CCGACCCCGGGCCGCGGCCGTGGCCAGCCAGTCAGCCG | 1338 |

TABLE 17-continued

CDKN2A Mutations and Genome-Correcting Oligos

| Clinical Phenotype & | Correcting Oligos | SEQ ID NO: |
|---|---|---|
| | GGCGCTGCTGGAGGCGG | 1339 |
| | CCGCCTCCAGCAGCGCC | 1340 |
| Melanoma Gly35Ala GGG→GCG | GGCTGGCCACGGCCGCGGCCCGGGGTCGGGTAGAGGAGGT GCGGGCGCTGCTGGAGGCGGGGGCGCTGCCCAACGCACCG AATAGTTACGGTCGGAGGCCGATCCAGGTGGGTAGAGGGTC | 1341 |
| | GACCCTCTACCCACCTGGATCGGCCTCCGACCGTAACTATTC GGTGCGTTGGGCAGCGCCCCCGCCTCCAGCAGCGCCCGCAC CTCCTCTACCCGACCCCGGGCCGCGGCCGTGGCCAGCC | 1342 |
| | GGAGGCGGGGGCGCTGC | 1343 |
| | GCAGCGCCCCCGCCTCC | 1344 |
| Melanoma Tyr44Term TACg→TAA | GGTAGAGGAGGTGCGGGCGCTGCTGGAGGCGGGGGCGCTG CCCAACGCACCGAATAGTTACGGTCGGAGGCCGATCCAGGTG GGTAGAGGGTCTGCAGCGGGAGCAGGGGATGGCGGGCGA | 1345 |
| | TCGCCCGCCATCCCCTGCTCCCGCTGCAGACCCTCTACCCAC CTGGATCGGCCTCCGACCGTAACTATTCGGTGCGTTGGGCAG CGCCCCCGCCTCCAGCAGCGCCCGCACCTCCTCTACC | 1346 |
| | AATAGTTACGGTCGGAG | 1346 |
| | CTCCGACCGTAACTATT | 1348 |
| Melanoma Met53Ile ATGa→ATC | TCTCCCATACCTGCCCCCACCCTGGCTCTGACCACTCTGCTC TCTCTGGCAGGTCATGATGATGGGCAGCGCCCGCGTGGCGG AGCTGCTGCTGCTCCACGGCGCGGAGCCCAACTGCGCA | 1349 |
| | TGCGCAGTTGGGCTCCGCGCCGTGGAGCAGCAGCAGCTCCG CCACGCGGGCGCTGCCCATCATCATGACCTGCCAGAGAGAG CAGAGTGGTCAGAGCCAGGGTGGGGGCAGGTATGGGAGA | 1350 |
| | GTCATGATGATGGGCAG | 1351 |
| | CTGCCCATCATCATGAC | 1352 |
| Melanoma Met54Ile ATGg→ATV | CCCATACCTGCCCCCACCCTGGCTCTGACACTCTGCTCTCT CTGGCAGGTCATGATGATGGGCAGCGCCCGCGTGGCGGAGC TGCTGCTGCTCCACGGCGCGGAGCCCAACTGCGCAGAC | 1353 |
| | GTCTGCGCAGTTGGGCTCCGCGCCGTGGAGCAGCAGCAGCT CCGCCACGCGGGCGCTGCCCATCATCATGACCTGCCAGAGA GAGCAGAGTGGTCAGAGCCAGGGTGGGGGCAGGTATGGG | 1354 |
| | ATGATGATGGGCAGCGC | 1355 |
| | GCGCTGCCCATCATCAT | 1356 |
| Melanoma Ser56Ile AGC→ATC | GCCGGCCCCACCCTGGCTCTGACCATTCTGTTCTCTCTGGC AGGTCATGATGATGGGCAGCGCCCGAGTGGCGGAGCTGCTG CTGCTCCACGGCGCGGAGCCCAACTGCGCCGACCCCGC | 1357 |
| | GCGGGGTCGGCGCAGTTGGGCTCCGCGCCGTGGAGCAGCA GCAGCTCCGCCACTCGGGCGCTGCCCATCATCATGACCTGCC AGAGAGAACAGAATGGTCAGAGCCAGGGTGGGGGCCGGC | 1358 |
| | GATGGGCAGCGCCCGAG | 1359 |
| | CTCGGGCGCTGCCCATC | 1360 |
| Melanoma Ala57Val GCC→GTC | GGCCCCCACCCTGGCTCTGACCATTCTGTTCTCTCTGGCAGG TCATGATGATGGGCAGCGCCCGAGTGGCGGAGCTGCTGCTG CTCCACGGCGCGGAGCCCAACTGCGCCGACCCCGCCAC | 1361 |
| | GTGGCGGGGTCGGCGCAGTTGGGCTCCGCGCCGTGGAGCA GCAGCAGCTCCGCCACTCGGGCGCTGCCCATCATCATGACCT GCCAGAGAGAACAGAATGGTCAGAGCCAGGGTGGGGGCC | 1362 |

TABLE 17-continued

CDKN2A Mutations and Genome-Correcting Oligos

| Clinical Phenotype & | Correcting Oligos | SEQ ID NO: |
|---|---|---|
| | GGGCAGCGCCCGAGTGG | 1363 |
| | CCACTCGGGCGCTGCCC | 1364 |
| Melanoma Arg58Term cCGA→TGA | CCCCCACCCTGGCTCTGACCATTCTGTTCTCTCTGGCAGGTC ATGATGATGGGCAGCGCCCGAGTGGCGGAGCTGCTGCTGCT CCACGGCGCGGAGCCCAACTGCGCCGACCCCGCCACTC | 1365 |
| | GAGTGGCGGGGTCGGCGCAGTTGGGCTCCGCGCCGTGGAG CAGCAGCAGCTCCGCCACTCGGGCGCTGCCCATCATCATGAC CTGCCAGAGAGAACAGAATGGTCAGAGCCAGGGTGGGGG | 1366 |
| | GCAGCGCCCGAGTGGCG | 1367 |
| | CGCCACTCGGGCGCTGC | 1368 |
| Melanoma Val59Gly GTG→GGG | CACCCTGGCTCTGACCATTCTGTTCTCTCTGGCAGGTCATGAT GATGGGCAGCGCCCGAGTGGCGGAGCTGCTGCTGCTCCACG GCGCGGAGCCCAACTGCGCCGACCCCGCCACTCTCAC | 1369 |
| | GTGAGAGTGGCGGGGTCGGCGCAGTTGGGCTCCGCGCCGTG GAGCAGCAGCAGCTCCGCCACTCGGGCGCTGCCCATCATCA TGACCTGCCAGAGAGAACAGAATGGTCAGAGCCAGGGTG | 1370 |
| | CGCCCGAGTGGCGGAGC | 1371 |
| | GCTCCGCCACTCGGGCG | 1372 |
| Melanoma Leu62Pro CTG→CCG | TCTGACCACTCTGCTCTCTCTGGCAGGTCATGATGATGGGCA GCGCCCGCGTGGCGGAGCTGCTGCTGCTCCACGGCGCGGA GCCCAACTGCGCAGACCCTGCCACTCTCACCCGACCGGT | 1373 |
| | ACCGGTCGGGTGAGAGTGGCAGGGTCTGCGCAGTTGGGCTC CGCGCCGTGGAGCAGCAGCAGCTCCGCCACGCGGGCGCTG CCCATCATCATGACCTGCCAGAGAGAGCAGAGTGGTCAGA | 1374 |
| | GGCGGAGCTGCTGCTGC | 1375 |
| | GCAGCAGCAGCTCCGCC | 1376 |
| Melanoma Ala68Val GCG→GTG | TCTGGCAGGTCATGATGATGGGCAGCGCCCGCGTGGCGGAG CTGCTGCTGCTCCACGGCGCGGAGCCCAACTGCGCAGACCC TGCCACTCTCACCCGACCGGTGCATGATGCTGCCCGGGA | 1377 |
| | TCCCGGGCAGCATCATGCACCGGTCGGGTGAGAGTGGCAGG GTCTGCGCAGTTGGGCTCCGCGCCGTGGAGCAGCAGCAGCT CCGCCACGCGGGCGCTGCCCATCATCATGACCTGCCAGA | 1378 |
| | CCACGGCGCGGAGCCCA | 1379 |
| | TGGGCTCCGCGCCGTGG | 1380 |
| Melanoma Asn71Lys AACt→AAA | CATGATGATGGGCAGCGCCCGAGTGGCGGAGCTGCTGCTGC TCCACGGCGCGGAGCCCAACTGCGCCGACCCCGCCACTCTC ACCCGACCCGTGCACGACGCTGCCCGGGAGGGCTTCCTG | 1381 |
| | CAGGAAGCCCTCCCGGGCAGCGTCGTGCACGGGTCGGGTGA GAGTGGCGGGGTCGGCGCAGTTGGGCTCCGCGCCGTGGAG CAGCAGCAGCTCCGCCACTCGGGCGCTGCCCATCATCATG | 1382 |
| | GAGCCCAACTGCGCCGA | 1383 |
| | TCGGCGCAGTTGGGCTC | 1384 |
| Melanoma Asn71Ser AAC→AGC | TCATGATGATGGGCAGCGCCCGAGTGGCGGAGCTGCTGCTG CTCCACGGCGCGGAGCCCAACTGCGCCGACCCCGCCACTCT CACCCGACCCGTGCACGACGCTGCCCGGGAGGGCTTCCT | 1385 |
| | AGGAAGCCCTCCCGGGCAGCGTCGTGCACGGGTCGGGTGAG AGTGGCGGGGTCGGCGCAGTTGGGCTCCGCGCCGTGGAGCA GCAGCAGCTCCGCCACTCGGGCGCTGCCCATCATCATGA | 1386 |

TABLE 17-continued

CDKN2A Mutations and Genome-Correcting Oligos

| Clinical Phenotype & | Correcting Oligos | SEQ ID NO: |
|---|---|---|
| | GGAGCCCAACTGCGCCG | 1387 |
| | CGGCGCAGTTGGGCTCC | 1388 |
| Melanoma Pro81Leu CCC→CTC | AGCTGCTGCTGCTCCACGGCGCGGAGCCCAACTGCGCCGAC CCGCCACTCTCACCCGACCCGTGCACGACGCTGCCCGGGA GGGCTTCCTGGACACGCTGGTGGTGCTGCACCGGGCCGG | 1389 |
| | CCGGCCCGGTGCAGCACCACCAGCGTGTCCAGGAAGCCCTC CCGGGCAGCGTCGTGCACGGGTCGGGTGAGAGTGGCGGGG TCGGCGCAGTTGGGCTCCGCGCCGTGGAGCAGCAGCAGCT | 1390 |
| | CACCCGACCCGTGCACG | 1391 |
| | CGTGCACGGGTCGGGTG | 1392 |
| Melanoma Asp84Tyr cGAC→TAC | CTGCTCCACGGCGCGGAGCCCAACTGCGCCGACCCCGCCAC TCTCACCCGACCCGTGCACGACGCTGCCCGGGAGGGCTTCC TGGACACGCTGGTGGTGCTGCACCGGGCCGGGGCGCGG | 1393 |
| | GCCGCGCCCCGGCCCGGTGCAGCACCACCAGCGTGTCCAGG AAGCCCTCCCGGGCAGCGTCGTGCACGGGTCGGGTGAGAGT GGCGGGGTCGGCGCAGTTGGGCTCCGCGCCGTGGAGCAG | 1394 |
| | CCGTGCACGACGCTGCC | 1395 |
| | GGCAGCGTCGTGCACGG | 1396 |
| Melanoma Ala85Thr cGCT→ACT | CTCCACGGCGCGGAGCCCAACTGCGCCGACCCCGCCACTCT CACCCGACCCGTGCACGACGCTGCCCGGGAGGGCTTCCTGG ACACGCTGGTGGTGCTGCACCGGGCCGGGGCGCGGCTGG | 1397 |
| | CCAGCCGCGCCCCGGCCCGGTGCAGCACCACCAGCGTGTCC AGGAAGCCCTCCCGGGCAGCGTCGTGCACGGGTCGGGTGAG AGTGGCGGGGTCGGCGCAGTTGGGCTCCGCGCCGTGGAG | 1398 |
| | TGCACGACGCTGCCCGG | 1399 |
| | CCGGGCAGCGTCGTGCA | 1400 |
| Melanoma Arg87Pro CGG→CCG | GCGCGGAGCCCAACTGCGCCGACCCCGCCACTCTCACCCGA CCCGTGCACGACGCTGCCCGGGAGGGCTTCCTGGACACGCT GGTGGTGCTGCACCGGGCCGGGGCGCGGCTGGACGTGCG | 1401 |
| | CGCACGTCCAGCCGCGCCCCGGCCCGGTGCAGCACCACCAG CGTGTCCAGGAAGCCCTCCCGGGCAGCGTCGTGCACGGGTC GGGTGAGAGTGGCGGGGTCGGCGCAGTTGGGCTCCGCGC | 1402 |
| | CGCTGCCCGGGAGGGCT | 1403 |
| | AGCCCTCCCGGGCAGCG | 1404 |
| Melanoma Arg87Trp cCGG→TGG | GGCGCGGAGCCCAACTGCGCCGACCCCGCCACTCTCACCCG ACCCGTGCACGACGCTGCCCGGGAGGGCTTCCTGGACACGC TGGTGGTGCTGCACCGGGCCGGGGCGCGGCTGGACGTGC | 1405 |
| | GCACGTCCAGCCGCGCCCCGGCCCGGTGCAGCACCACCAGC GTGTCCAGGAAGCCCTCCCGGGCAGCGTCGTGCACGGGTCG GGTGAGAGTGGCGGGGTCGGCGCAGTTGGGCTCCGCGCC | 1406 |
| | ACGCTGCCCGGGAGGGC | 1407 |
| | GCCCTCCCGGGCAGCGT | 1408 |
| Melanoma Leu97Arg CTG→CGG | CTCTCACCCGACCGGTGCATGATGCTGCCCGGGAGGGCTTC CTGGACACGCTGGTGGTGCTGCACCGGGCCGGGGCGCGGCT GGACGTGCGCGATGCCTGGGGTCGTCTGCCCGTGGACTT | 1409 |
| | AAGTCCACGGGCAGACGACCCCAGGCATCGCGCACGTCCAG CCGCGCCCCGGGCCGGTGCAGCACCACCAGCGTGTCCAGGA AGCCCTCCCGGGCAGCATCATGCACCGGTCGGGTGAGAG | 1410 |

TABLE 17-continued

CDKN2A Mutations and Genome-Correcting Oligos

| Clinical Phenotype & | Correcting Oligos | SEQ ID NO: |
|---|---|---|
| | GGTGGTGCTGCACCGGG | 1411 |
| | CCCGGTGCAGCACCACC | 1412 |
| Melanoma Arg99Pro CGG→CCG | CCCGACCGGTGCATGATGCTGCCCGGGAGGGCTTCCTGGAC ACGCTGGTGGTGCTGCACCGGGCCGGGGCGCGGCTGGACG TGCGCGATGCCTGGGGTCGTCTGCCCGTGGACTTGGCCGA | 1413 |
| | TCGGCCAAGTCCACGGGCAGACGACCCCAGGCATCGCGCAC GTCCAGCCGCGCCCCGGCCCGGTGCAGCACCACCAGCGTGT CCAGGAAGCCCTCCCGGGCAGCATCATGCACCGGTCGGG | 1414 |
| | GCTGCACCGGGCCGGGG | 1415 |
| | CCCCGGCCCGGTGCAGC | 1416 |
| Melanoma Gly101Trp cGGG→TGG | CCGGTGCATGATGCTGCCCGGGAGGGCTTCCTGGACACGCT GGTGGTGCTGCACCGGGCCGGGGCGCGGCTGGACGTGCGC GATGCCTGGGGTCGTCTGCCCGTGGACTTGGCCGAGGAGC | 1417 |
| | GCTCCTCGGCCAAGTCCACGGGCAGACGACCCCAGGCATCG CGCACGTCCAGCCGCGCCCCGGCCCGGTGCAGCACCACCAG CGTGTCCAGGAAGCCCTCCCGGGCAGCATCATGCACCGG | 1418 |
| | ACCGGGCCGGGGCGCGG | 1419 |
| | CCGCGCCCCGGCCCGGT | 1420 |
| Melanoma Arg107Cys gCGC→TGC | CGGGAGGGCTTCCTGGACACGCTGGTGGTGCTGCACCGGGC CGGGGCGCGGCTGGACGTGCGCGATGCCTGGGGTCGTCTGC CCGTGGACTTGGCCGAGGAGCGGGGCCACCGCGACGTTG | 1421 |
| | CAACGTCGCGGTGGCCCCGCTCCTCGGCCAAGTCCACGGGC AGACGACCCCAGGCATCGCGCACGTCCAGCCGCGCCCCGGC CCGGTGCAGCACCACCAGCGTGTCCAGGAAGCCCTCCCG | 1422 |
| | TGGACGTGCGCGATGCC | 1423 |
| | GGCATCGCGCACGTCCA | 1424 |
| Melanoma Ala118Thr gGCT→ACT | CACCGGGCCGGGGCGCGGCTGGACGTGCGCGATGCCTGGG GCCGTCTGCCCGTGGACCTGGCTGAGGAGCTGGGCCATCGC GATGTCGCACGGTACCTGCGCGCGGCTGCGGGGGGCACCA | 1425 |
| | TGGTGCCCCCCGCAGCCGCGCGCAGGTACCGTGCGACATCG CGATGGCCCAGCTCCTCAGCCAGGTCCACGGGCAGACGGCC CCAGGCATCGCGCACGTCCAGCCGCGCCCCGGCCCGGTG | 1426 |
| | TGGACCTGGCTGAGGAG | 1427 |
| | CTCCTCAGCCAGGTCCA | 1428 |
| Melanoma Val126Asp GTC→GAC | TGCGCGATGCCTGGGGCCGTCTGCCCGTGGACCTGGCTGAG GAGCTGGGCCATCGCGATGTCGCACGGTACCTGCGCGCGGC TGCGGGGGGCACCAGAGGCAGTAACCATGCCCGCATAGA | 1429 |
| | TCTATGCGGGCATGGTTACTGCCTCTGGTGCCCCCCGCAGCC GCGCGCAGGTACCGTGCGACATCGCGATGGCCCAGCTCCTC AGCCAGGTCCACGGGCAGACGGCCCCAGGCATCGCGCA | 1430 |
| | TCGCGATGTCGCACGGT | 1431 |
| | ACCGTGCGACATCGCGA | 1432 |

EXAMPLE 11

Adenomatous Polyposis of the Colon—APC

Adenomatous polyposis of the colon is characterized by adenomatous polyps of the colon and rectum; in extreme cases the bowel is carpeted with a myriad of polyps. This is a viciously premalignant disease with one or more polyps progressing through dysplasia to malignancy in untreated gene carriers with a median age at diagnosis of 40 years.

Mutations in the APC gene are an initiating event for both familial and sporadic colorectal tumorigenesis and many alleles of the APC gene have been identified. Carcinoma may arise at any age from late childhood through the seventh decade with presenting features including, for example, weight loss and inanition, bowel obstruction, or bloody diarrhea. Cases of new mutation still present in these ways but in areas with well organized registers most other gene carriers are detected. The attached table discloses the correcting oligonucleotide base sequences for the APC oligonucleotides of the invention.

TABLE 18

APC Mutations and Genome-Correcting Oligos

| Clinical Phenotype & Mutation | Correcting oligos | SEQ ID NO: |
|---|---|---|
| Adenomatous polyposis coli Arg121Term AGA-TGA | GGATCTGTATCAAGCCGTTCTGGAGAGTGCAGTCCTGTTCCT ATGGGTTCATTTCCAAGAAGAGGGTTTGTAAATGGAAGCAGA GAAAGTACTGGATATTTAGAAGAACTTGAGAAAGAGA | 1433 |
| | TCTCTTTCTCAAGTTCTTCTAAATATCCAGTACTTTCTCTGCTT CCATTTACAAACCCTCTTCTTGGAAATGAACCCATAGGAACAG GACTGCACTCTCCAGAACGGCTTGATACAGATCC | 1434 |
| | TTCCAAGAAGAGGGTTT | 1435 |
| | AAACCCTCTTCTTGGAA | 1436 |
| Adenomatous polyposis coli Trp157Term TGG-TAG | AAAAAAAAAATAGGTCATTGCTTCTTGCTGATCTTGACAAAGAA GAAAAGGAAAAAGACTGGTATTACGCTCAACTTCAGAATCTCA CTAAAAGAATAGATAGTCTTCCTTTAACTGAAAA | 1437 |
| | TTTTCAGTTAAAGGAAGACTATCTATTCTTTTAGTGAGATTCTG AAGTTGAGCGTAATACCAGTCTTTTTCCTTTTCTTCTTTGTCAA GATCAGCAAGAAGCAATGACCTATTTTTTTTT | 1438 |
| | AAAAGACTGGTATTACG | 1439 |
| | CGTAATACCAGTCTTTT | 1440 |
| Adenomatous polyposis coli Tyr159Term TAG-TAG | AAATAGGTCATTGCTTCTTGCTGATCTTGACAAAGAAGAAAAG GAAAAAGACTGGTATTACGCTCAACTTCAGAATCTCACTAAAA GAATAGATAGTCTTCCTTTAACTGAAAATGTAAGT | 1441 |
| | ACTTACATTTTCAGTTAAAGGAAGACTATCTATTCTTTTAGTGA GATTCTGAAGTTGAGCGTAATACCAGTCTTTTTCCTTTTCTTCT TGTCAAGATCAGCAAGAAGCAATGACCTATTT | 1442 |
| | TGGTATTACGCTCAACT | 1443 |
| | AGTTGAGCGTAATACCA | 1444 |
| Adenomatous polyposis coli Gln163Term CAG-TAG | TTGCTTCTTGCTGATCTTGACAAAGAAGAAAAGGAAAAAGACT GGTATTACGCTCAACTTCAGAATCTCACTAAAAGAATAGATAG TCTTCCTTTAACTGAAAATGTAAGTAACTGGCAGT | 1445 |
| | ACTGCCAGTTACTTACATTTTCAGTTAAAGGAAGACTATCTATT CTTTTAGTGAGATTCTGAAGTTGAGCGTAATACCAGTCTTTTTC CTTTTCTTCTTTGTCAAGATCAGCAAGAAGCAA | 1446 |
| | CTCAACTTCAGAATCTC | 1447 |
| | GAGATTCTGAAGTTGAG | 1448 |
| Adenomatous polyposis coli Arg168Term AGA-TGA | CTTGACAAAGAAGAAAAGGAAAAAGACTGGTATTACGCTCAAC TTCAGAATCTCACTAAAAGAATAGATAGTCTTCCTTTAACTGAA AATGTAAGTAACTGGCAGTACAACTTATTTGAAA | 1449 |
| | TTTCAAATAAGTTGTACTGCCAGTTACTTACATTTTCAGTTAAA GGAAGACTATCTATTCTTTTAGTGAGATTCTGAAGTTGAGCGT AATACCAGTCTTTTTCCTTTTCTTCTTTGTCAAG | 1450 |
| | TCACTAAAAGAATAGAT | 1451 |
| | ATCTATTCTTTTAGTGA | 1452 |
| Adenomatous polyposis coli Ser171Ile AGT-ATT | AAGAAAAGGAAAAAGACTGGTATTACGCTCAACTTCAGAATCT CACTAAAAGAATAGATAGTCTTCCTTTAACTGAAAATGTAAGTA ACTGGCAGTACAACTTATTTGAAACTTTAATAAC | 1453 |
| | GTTATTAAAGTTTCAAATAAGTTGTACTGCCAGTTACTTACATT TTCAGTTAAAGGAAGACTATCTATTCTTTTAGTGAGATTCTGAA GTTGAGCGTAATACCAGTCTTTTTCCTTTTCTT | 1454 |

TABLE 18-continued

APC Mutations and Genome-Correcting Oligos

| Clinical Phenotype & Mutation | Correcting oligos | SEQ ID NO: |
|---|---|---|
| | AATAGATAGTCTTCCTT | 1455 |
| | AAGGAAGACTATCTATT | 1456 |
| Adenomatous polyposis coli<br>Gln181Term<br>CAA-TAA | GATTAACGTAAATACAAGATATTGATACTTTTTATTATTTGTGG<br>TTTTAGTTTTCCTTACAAACAGATATGACCAGAAGGCAATTGG<br>AATATGAAGCAAGGCAAATCAGAGTTGCGATGG | 1457 |
| | CCATCGCAACTCTGATTTGCCTTGCTTCATATTCCAATTGCCT<br>TCTGGTCATATCTGTTTGTAAGGAAAACTAAAACCACAAATAAT<br>AAAAAAGTATCAATATCTTGTATTTACGTTAATC | 1458 |
| | TTTCCTTACAAACAGAT | 1459 |
| | ATCTGTTTGTAAGGAAA | 1460 |
| Adenomatous polyposis coli<br>Glu190Term<br>GAA-TAA | CTTTTTTATTATTTGTGGTTTTAGTTTTCCTTACAAACAGATATG<br>ACCAGAAGGCAATTGGAATATGAAGCAAGGCAAATCAGAGTT<br>GCGATGGAAGAACAACTAGGTACCTGCCAGGATA | 1461 |
| | TATCCTGGCAGGTACCTAGTTGTTCTTCCATCGCAACTCTGAT<br>TTGCCTTGCTTCATATTCCAATTGCCTTCTGGTCATATCTGTTT<br>GTAAGGAAAACTAAAACCACAAATAATAAAAAAG | 1462 |
| | GGCAATTGGAATATGAA | 1463 |
| | TTCATATTCCAATTGCC | 1464 |
| Adenomatous polyposis coli<br>Gln208Term<br>CAG-TAG | CAATTGGAATATGAAGCAAGGCAAATCAGAGTTGCGATGGAA<br>GAACAACTAGGTACCTGCCAGGATATGGAAAAACGAGCACAG<br>GTAAGTTACTTGTTTCTAAGTGATAAAACAGCGAAGA | |
| | TCTTCGCTGTTTTATCACTTAGAAACAAGTAACTTACCTGTGCT<br>CGTTTTTCCATATCCTGGCAGGTACCTAGTTGTTCTTCCATCG<br>CAACTCTGATTTGCCTTGCTTCATATTCCAATTG | 1466 |
| | GTACCTGCCGCAGGTAC | 1467 |
| | CATATCCTGGCAGGTAC | 1468 |
| Adenomatous polyposis coli<br>Arg213Term<br>CGA-TGA | GCAAGGCAAATCAGAGTTGCGATGGAAGAACAACTAGGTACC<br>TGCCAGGATATGGAAAAACGAGCACAGGTAAGTTACTTGTTTC<br>TAAGTGATAAAACAGCGAAGAGCTATTAGGAATAAA | 1469 |
| | TTTATTCCTAATAGCTCTTCGCTGTTTTATCACTTAGAAACAAG<br>TAACTTACCTGTGCTCGTTTTTCCATATCCTGGCAGGTACCTA<br>GTTGTTCTTCCATCGCAACTCTGATTTGCCTTGC | 1470 |
| | TGGAAAAACGAGCACAG | 1471 |
| | CTGTGCTCGTTTTTCCA | 1472 |
| Adenomatous polyposis coli<br>Arg232Term<br>CGA-TGA | GTTTTATTTTAGCGAAGAATAGCCAGAATTCAGCAAATCGAAA<br>AGGACATACTTCGTATACGACAGCTTTTACAGTCCCAAGCAAC<br>AGAAGCAGAGGTTAGTAAATTGCCTTTCTTGTTTG | 1473 |
| | CAAACAAGAAAGGCAATTTACTAACCTCTGCTTCTGTTGCTTG<br>GGACTGTAAAAGCTGTCGTATACGAAGTATGTCCTTTTCGATT<br>TGCTGAATTCTGGCTATTCTTCGCTAAAATAAAAC | 1474 |
| | TTCGTATACGACAGCTT | 1475 |
| | AAGCTGTCGTATACGAA | 1476 |
| Adenomatous polyposis coli<br>Gln233Term<br>CAG-TAG | TTATTTTAGCGAAGAATAGCCAGAATTCAGCAAATCGAAAGG<br>ACATACTTCGTATACGACAGCTTTTACAGTCCCAAGCAACAGA<br>AGCAGAGGTTAGTAAATTGCCTTTCTTGTTTGTGG | 1477 |
| | CCACAAACAAGAAAGGCAATTTACTAACCTCTGCTTCTGTTGC<br>TTGGGACTGTAAAAGCTGTCGTATACGAAGTATGTCCTTTTCG<br>ATTTGCTGAATTCTGGCTATTCTTCGCTAAAATAA | 1478 |

TABLE 18-continued

APC Mutations and Genome-Correcting Oligos

| Clinical Phenotype & Mutation | Correcting oligos | SEQ ID NO: |
|---|---|---|
| | GTATACGACAGCTTTTA | 1479 |
| | TAAAAGCTGTCGTATAC | 1480 |
| Adenomatous polyposis coli Gln247Term CAG-TAG | AGAAAGCCTACACCATTTTTGCATGTACTGATGTTAACTCCAT CTTAACAGAGGTCATCTCCTCACAGAACAAGCATGAAACCGGCTCAC ATGATGCTGAGCGGCAGAATGAAGGTCAAGGAGTGG | 1481 |
| | CCACTCCTTGACCTTCATTCTGCCGCTCAGCATCATGTGAGC CGGTTTCATGCTTGTTCTGAGATGACCTCTGTTAAGATGGAGT TAACATCAGTACATGCAAAAATGGTGTAGGCTTTCT | 1482 |
| | GGTCATCTCAGAACAAG | 1483 |
| | CTTGTTCTGAGATGACC | 1484 |
| Adenomatous polyposis coli Gly267Term GGA-TGA | CAGAACAAGCATGAAACCGGCTCACATGATGCTGAGCGGCAG AATGAAGGTCAAGGAGTGGGAGAAATCAACATGGCAACTTCT GGTAATGGTCAGGTAAATAAATTATTTTATCATATTT | 1485 |
| | AAATATGATAAAATAATTTATTTACCTGACCATTACCAGAAGTT GCCATGTTGATTTCTCCCACTCCTTGACCTTCATTCTGCCGCT CAGCATCATGTGAGCCGGTTTCATGCTTGTTCTG | 1486 |
| | AAGGAGTGGGAGAAATC | 1487 |
| | GATTTCTCCCACTCCTT | 1488 |
| Adenomatous polyposis coli Glu443Term GAA-TAA | CTTCAAATAACAAAGCATTATGGTTTATGTTGATTTTATTTTTCA GTGCCAGCTCCTGTTGAACATCAGATCTGTCCTGCTGTGTGT GTTCTAATGAAACTTTCATTTGATGAAGAGCATA | 1489 |
| | TATGCTCTTCATCAAATGAAAGTTTCATTAGAACACACACAGCA GGACAGATCTGATGTTCAACAGGAGCTGGCACTGAAAAATAA AATCAACATAAACCATAATGCTTTGTTATTTGAAG | 1490 |
| | CTCCTGTTGAACATCAG | 1491 |
| | CTGATGTTCAACAGGAG | 1492 |
| Adenomatous polyposis coli SER457TER TCA-TAA | CAGTGCCAGCTCCTGTTGAACATCAGATCTGTCCTGCTGTGT GTGTTCTAATGAAACTTTCATTTGATGAAGAGCATAGACATGC AATGAATGAACTAGGTAAGACAAAAATGTTTTTTAA | 1493 |
| | TTAAAAACATTTTTGTCTTACCTAGTTCATTCATTGCATGTCTA TGCTCTTCATCAAATGAAAGTTTCATTAGAACACACACAGCAG GACAGATCTGATGTTCAACAGGAGCTGGCACTG | 1494 |
| | GAAACTTTCATTTGATG | 1495 |
| | CATCAAATGAAAGTTTC | 1496 |
| Adenomatous polyposis coli Gln473Term CAG-TAG | AGTTGTTTTATTTTAGATGATTGTCTTTTTCCTCTTGCCCTTTTT AAATTAGGGGGACTACAGGCCATTGCAGAATTATTGCAAGTG GACTGTGAAATGTACGGGCTTACTAATGACCACT | 1497 |
| | AGTGGTCATTAGTAAGCCCGTACATTTCACAGTCCACTTGCAA TAATTCTGCAATGGCCTGTAGTCCCCTAATTTAAAAAGGGCA AGAGGAAAAAGACAATCATCTAAAATAAAACAACT | 1498 |
| | GGGGACTACAGGCCATT | 1499 |
| | AATGGCCTGTAGTCCCC | 1500 |
| Adenomatous polyposis coli Tyr486Term TAC-TAG | TTTTAAATTAGGGGGACTACAGGCCATTGCAGAATTATTGCAA GTGGACTGTGAAATGTACGGGCTTACTAATGACCACTACAGTA TTACACTAAGACGATATGCTGGAATGGCTTTGACA | 1501 |
| | TGTCAAAGCCATTCCAGCATATCGTCTTAGTGTAATACTGTAG TGGTCATTAGTAAGCCCGTACATTTCACAGTCCACTTGCAATA ATTCTGCAATGGCCTGTAGTCCCCTAATTTAAAA | 1502 |

TABLE 18-continued

APC Mutations and Genome-Correcting Oligos

| Clinical Phenotype & Mutation | Correcting oligos | SEQ ID NO: |
|---|---|---|
| | GAAATGTACGGGCTTAC | 1503 |
| | GTAAGCCCGTACATTTC | 1504 |
| Adenomatous polyposis coli Arg499Term CGA-TGA | TTGCAAGTGGACTGTGAAATGTATGGGCTTACTAATGACCACT ACAGTATTACACTAAGACGATATGCTGGAATGGCTTTGACAAA CTTGACTTTTGGAGATGTAGCCAACAAGGTATGTT | 1505 |
| | AACATACCTTGTTGGCTACATCTCCAAAAGTCAAGTTTGTCAA AGCCATTCCAGCATATCGTCTTAGTGTAATACTGTAGTGGTCA TTAGTAAGCCCATACATTTCACAGTCCACTTGCAA | 1506 |
| | CACTAAGACGATATGCT | 1507 |
| | AGCATATCGTCTTAGTG | 1508 |
| Adenomatous polyposis coli Tyr500Term TAT-TAG | AGTGGACTGTGAAATGTATGGGCTTACTAATGACCACTACAGT ATTACACTAAGACGATATGCTGGAATGGCTTTGACAAACTTGA CTTTTGGAGATGTAGCCAACAAGGTATGTTTTTAT | 1509 |
| | ATAAAAACATACCTTGTTGGCTACATCTCCAAAAGTCAAGTTTG TCAAAGCCATTCCAGCATATCGTCTTAGTGTAATACTGTAGTG GTCATTAGTAAGCCCATACATTTCACAGTCCACT | 1510 |
| | AGACGATATGCTGGAAT | 1511 |
| | ATTCCAGCATATCGTCT | 1512 |
| Adenomatous polyposis coli Lys586Term AAA-TAA | GACAAATTCCAACTCTAATTAGATGACCCATATTCTGTTTCTTA CTAGGAATCAACCCTCAAAAGCGTATTGAGTGCCTTATGGAAT TTGTCAGCACATTGCACTGAGAATAAAGCTGATA | 1513 |
| | TATCAGCTTTATTCTCAGTGCAATGTGCTGACAAATTCCATAA GGCACTCAATACGCTTTTGAGGGTTGATTCCTAGTAAGAAACA GAATATGGGTCATCTAATTAGAGTTGGAATTTGTC | 1514 |
| | CAACCCTCAAAAGCGTA | 1515 |
| | TACGCTTTTGAGGGTTG | 1516 |
| Adenomatous polyposis coli Leu592Term TTA-TGA | TAGATGACCCATATTCTGTTTCTTACTAGGAATCAACCCTCAAA AGCGTATTGAGTGCCTTATGGAATTTGTCAGCACATTGCACTG AGAATAAAGCTGATATATGTGCTGTAGATGGTGC | 1517 |
| | GCACCATCTACAGCACATATATCAGCTTTATTCTCAGTGCAAT GTGCTGACAAATTCCATAAGGCACTCAATACGCTTTTGAGGGT TGATTCCTAGTAAGAAACAGAATATGGGTCATCTA | 1518 |
| | GAGTGCCTTATGGAATT | 1519 |
| | AATTCCATAAGGCACTC | 1520 |
| Adenomatous polyposis coli Trp593Term TGG-TAG | ATGACCCATATTCTGTTTCTTACTAGGAATCAACCCTCAAAAG CGTATTGAGTGCCTTATGGAATTTGTCAGCACATTGCACTGAG AATAAAGCTGATATATGTGCTGTAGATGGTGCACT | 1521 |
| | AGTGCACCATCTACAGCACATATATCAGCTTTATTCTCAGTGC AATGTGCTGACAAATTCCATAAGGCACTCAATACGCTTTTGAG GGTTGATTCCTAGTAAGAAACAGAATATGGGTCAT | 1522 |
| | TGCCTTATGGAATTTGT | 1523 |
| | ACAAATTCCATAAGGCA | 1524 |
| Adenomatous polyposis coli Trp593Term TGG-TGA | TGACCCATATTCTGTTTCTTACTAGGAATCAACCCTCAAAAGC GTATTGAGTGCCTTATGGAATTTGTCAGCACATTGCACTGAGA ATAAAGCTGATATATGTGCTGTAGATGGTGCACTT | 1525 |
| | AAGTGCACCATCTACAGCACATATATCAGCTTTATTCTCAGTG CAATGTGCTGACAAATTCCATAAGGCACTCAATACGCTTTTGA GGGTTGATTCCTAGTAAGAAACAGAATATGGGTCA | 1526 |

TABLE 18-continued

APC Mutations and Genome-Correcting Oligos

| Clinical Phenotype & Mutation | Correcting oligos | SEQ ID NO: |
|---|---|---|
| | GCCTTATGGAATTTGTC | 1527 |
| | GACAAATTCCATAAGGC | 1528 |
| Adenomatous polyposis coli<br>Tyr622Term<br>TAC-TAA | TAAAGCTGATATATGTGCTGTAGATGGTGCACTTGCATTTTTG<br>GTTGGCACTCTTACTTATCCGGAGCCAGACAAACACTTTAGCC<br>ATTATTGAAAGTGGAGGTGGGATATTACGGAATGTG | 1529 |
| | CACATTCCGTAATATCCCACCTCCACTTTCAATAATGGCTAAA<br>GTGTTTGTCTGGCTCCGGTAAGTAAGAGTGCCAACCAAAAAT<br>GCAAGTGCACCATCTACAGCACATATATCAGCTTTA | 1530 |
| | CTTACTTACCGGAGCCA | 1531 |
| | TGGCTCCGGTAAGTAAG | 1532 |
| Adenomatous polyposis coli<br>Gln625Term<br>CAG-TAG | GATATATGTGCTGTAGATGGTGCACTTGCATTTTTGGTTGGCA<br>CTCTTACTTACCGGAGCCAGACAAACACTTTAGCCATTATTGA<br>AAGTGGAGGTGGGATATTACGGAATGTGTCCAGCT | 1533 |
| | AGCTGGACACATTCCGTAATATCCCACCTCCACTTTCAATAAT<br>GGCTAAAGTGTTTGTCTGGCTCCGGTAAGTAAGAGTGCCAAC<br>CAAAAATGCAAGTGCACCATCTACAGCACATATATC | 1534 |
| | ACCGGAGCCAGACAAAC | 1535 |
| | GTTTGTCTGGCTCCGGT | 1536 |
| Adenomatous polyposis coli<br>Leu629Term<br>TTA-TAA | TAGATGGTGCACTTGCATTTTTGGTTGGCACTCTTACTTACCG<br>GAGCCAGACAAACACTTTAGCCATTATTGAAAGTGGAGGTGG<br>GATATTACGGAATGTGTCCAGCTTGATAGCTACAAA | 1537 |
| | TTTGTAGCTATCAAGCTGGACACATTCCGTAATATCCCACCTC<br>CACTTTCAATAATGGCTAAAGTGTTTGTCTGGCTCCGGTAAGT<br>AAGAGTGCCAACCAAAAATGCAAGTGCACCATCTA | 1538 |
| | AAACACTTTAGCCATTA | 1539 |
| | TAATGGCTAAAGTGTTT | 1540 |
| Adenomatous polyposis coli<br>Glu650Term<br>GAG-TAG | GCCATTATTGAAAGTGGAGGTGGGATATTACGGAATGTGTCC<br>AGCTTGATAGCTACAAATGAGGACCACAGGTATATATAGAGTT<br>TTATATTACTTTTAAAGTACAGAATTCATACTCTCA | 1541 |
| | TGAGAGTATGAATTCTGTACTTTAAAAGTAATATAAAACTCTAT<br>ATATACCTGTGGTCCTCATTTGTAGCTATCAAGCTGGACACAT<br>TCCGTAATATCCCACCTCCACTTTCAATAATGGC | 1542 |
| | CTACAAATGAGGACCAC | 1543 |
| | GTGGTCCTCATTTGTAG | 1544 |
| Adenomatous polyposis coli<br>Trp699Term<br>TGG-TGA | TGCATGTGGAACTTTGTGGAATCTCTCAGCAAGAAATCCTAAA<br>GACCAGGAAGCATTATGGGACATGGGGGCAGTTAGCATGCTC<br>AAGAACCTCATTCATTCAAAGCACAAAATGATTGCT | 1545 |
| | AGCAATCATTTTGTGCTTTGAATGAATGAGGTTCTTGAGCATG<br>CTAACTGCCCCCATGTCCCATAATGCTTCCTGGTCTTTAGGAT<br>TTCTTGCTGAGAGATTCCACAAAGTTCCACATGCA | 1546 |
| | GCATTATGGGACATGGG | 1547 |
| | CCCATGTCCCATAATGC | 1548 |
| Adenomatous polyposis coli<br>Ser713Term<br>TCA-TGA | AAGACCAGGAAGCATTATGGGACATGGGGGCAGTTAGCATGC<br>TCAAGAACCTCATTCATTCAAAGCACAAAATGATTGCTATGGG<br>AAGTGCTGCAGCTTTAAGGAATCTCATGGCAAATAG | 1549 |
| | CTATTTGCCATGAGATTCCTTAAAGCTGCAGCACTTCCCATAG<br>CAATCATTTTGTGCTTTGAATGAATGAGGTTCTTGAGCATGCT<br>AACTGCCCCCATGTCCCATAATGCTTCCTGGTCTT | 1550 |

TABLE 18-continued

APC Mutations and Genome-Correcting Oligos

| Clinical Phenotype & Mutation | Correcting oligos | SEQ ID NO: |
|---|---|---|
| | CATTCATTCAAAGCACA | 1551 |
| | TGTGCTTTGAATGAATG | 1552 |
| Adenomatous polyposis coli Ser722Gly AGT-GGT | GGGGCAGTTAGCATGCTCAAGAACCTCATTCATTCAAAGCAC AAAATGATTGCTATGGGAAGTGCTGCAGCTTTAAGGAATCTCA TGGCAAATAGGCCTGCGAAGTACAAGGATGCCAATA | 1553 |
| | TATTGGCATCCTTGTACTTCGCAGGCCTATTTGCCATGAGATT CCTTAAAGCTGCAGCACTTCCCATAGCAATCATTTTGTGCTTT GAATGAATGAGGTTCTTGAGCATGCTAACTGCCCC | 1554 |
| | CTATGGGAAGTGCTGCA | 1555 |
| | TGCAGCACTTCCCATAG | 1556 |
| Adenomatous polyposis coli Leu764Term TTA-TAA | TCTCCTGGCTCAGCTTGCCATCTCTTCATGTTAGGAAACAAAA AGCCCTAGAAGCAGAATTAGATGCTCAGCACTTATCAGAAACT TTTGACAATATAGACAATTTAAGTCCCAAGGCATC | 1557 |
| | GATGCCTTGGGACTTAAATTGTCTATATTGTCAAAAGTTTCTGA TAAGTGCTGAGCATCTAATTCTGCTTCTAGGGCTTTTTGTTTC CTAACATGAAGAGATGGCAAGCTGAGCCAGGAGA | 1558 |
| | AGCAGAATTAGATGCTC | 1559 |
| | GAGCATCTAATTCTGCT | 1560 |
| Adenomatous polyposis coli Ser784Thr TCT-ACT | TTAGATGCTCAGCACTTATCAGAAACTTTTGACAATATAGACAA TTTAAGTCCCAAGGCATCTCATCGTAGTAAGCAGAGACACAG CAAGTCTCTATGGTGATTATGTTTTTGACACCATC | 1561 |
| | GATGGTGTCAAAAACATAATCACCATAGAGACTTGCTGTGTCT CTGCTTACTACGATGAGATGCCTTGGGACTTAAATTGTCTATA TTGTCAAAAGTTTCTGATAAGTGCTGAGCATCTAA | 1562 |
| | CCAAGGCATCTCATCGT | 1563 |
| | ACGATGAGATGCCTTGG | 1564 |
| Adenomatous polyposis coli Arg805Term CGA-TGA | CTCATCGTAGTAAGCAGAGACACAGCAAGTCTCTATGGTGATT ATGTTTTTGACACCAATCGACATGATGATAATAGGTCAGACAT TTTAATACTGGCACATGACTGTCCTTTCACCATAT | 1565 |
| | ATATGGTGAAAGGACAGTCATGTGCCAGTATTAAAATGTCTGA CCTATTATCATCATGTCGATTGGTGTCAAAAACATAATCACCAT AGAGACTTGCTGTGTCTCTGCTTACTACGATGAG | 1566 |
| | ACACCAATCGACATGAT | 1567 |
| | ATCATGTCGATTGGTGT | 1568 |
| Adenomatous polyposis coli Gln879Term CAG-TAG | GGTCTAGGCAACTACCATCCAGCAACAGAAAATCCAGGAACT TCTTCAAAGCGAGGTTTGCAGATCTCCACCACTGCAGCCCAG ATTGCCAAAGTCATGGAAGAAGTGTCAGCCATTCATA | 1569 |
| | TATGAATGGCTGACACTTCTTCCATGACTTTGGCAATCTGGGC TGCAGTGGTGGAGATCTGCAAACCTCGCTTTGAAGAAGTTCC TGGATTTTCTGTTGCTGGATGGTAGTTGCCTAGACC | 1570 |
| | GAGGTTTGCAGATCTCC | 1571 |
| | GGAGATCTGCAAACCTC | 1572 |
| Adenomatous polyposis coli Ser932Term TCA-TAA | TACATTGTGTGACAGATGAGAGAAATGCACTTAGAAGAAGCTC TGCTGCCCATACACATTCAAACACTTACAATTTCACTAAGTCG GAAAATTCAAATAGGACATGTTCTATGCCTTATGC | 1573 |
| | GCATAAGGCATAGAACATGTCCTATTTGAATTTTCCGACTTAG TGAAATTGTAAGTGTTTGAATGTGTATGGGCAGCAGAGCTTCT TCTAAGTGCATTTCTCTCATCTGTCACACAATGTA | 1514 |

TABLE 18-continued

APC Mutations and Genome-Correcting Oligos

| Clinical Phenotype & Mutation | Correcting oligos | SEQ ID NO: |
|---|---|---|
| | TACACATTCAAACACTT | 1575 |
| | AAGTGTTTGAATGTGTA | 1576 |
| Adenomatous potyposis coli Ser932Term TCA-TGA | TACATTGTGTGACAGATGAGAGAAATGCACTTAGAAGAAGCTC TGCTGCCCATACACATTCAAACACTTACAATTTCACTAAGTCG GAAAATTCAAATAGGACATGTTCTATGCCTTATGC | 1577 |
| | GCATAAGGCATAGAACATGTCCTATTTGAATTTTCCGACTTAG TGAAATTGTAAGTGTTTGAATGTGTATGGGCAGCAGAGCTTCT TCTAAGTGCATTTCTCTCATCTGTCACACAATGTA | 1578 |
| | TACACATTCAAACACTT | 1579 |
| | AAGTGTTTGAATGTGTA | 1580 |
| Adenomatous polyposis coli Tyr935Term TAC-TAG | GACAGATGAGAGAAATGCACTTAGAAGAAGCTCTGCTGCCCA TACACATTCAAACACTTACAATTTCACTAAGTCGGAAAATTCAA ATAGGACATGTTCTATGCCTTATGCCAAATTAGAA | 1581 |
| | TTCTAATTTGGCATAAGGCATAGAACATGTCCTATTTGAATTTT CCGACTTAGTGAAATTGTAAGTGTTTGAATGTGTATGGGCAGC AGAGCTTCTTCTAAGTGCATTTCTCTCATCTGTC | 1582 |
| | AACACTTACAATTTCAC | 1583 |
| | GTGAAATTGTAAGTGTT | 1584 |
| Adenomatous polyposis coli Tyr935Term TAC-TAA | GACAGATGAGAGAAATGCACTTAGAAGAAGCTCTGCTGCCCA TACACATTCAAACACTTACAATTTCACTAAGTCGGAAAATTCAA ATAGGACATGTTCTATGCCTTATGCCAAATTAGAA | 1585 |
| | TTCTAATTTGGCATAAGGCATAGAACATGTCCTATTTGAATTTT CCGACTTAGTGAAATTGTAAGTGTTTGAATGTGTATGGGCAGC AGAGCTTCTTCTAAGTGCATTTCTCTCATCTGTC | 1586 |
| | AACACTTACAATTTCAC | 1587 |
| | GTGAAATTGTAAGTGTT | 1588 |
| Adenomatous polyposis coli Tyr1000Term TAC-TAA | ACCCTCGATTGAATCCTATTCTGAAGATGATGAAAGTAAGTTTT GCAGTTATGGTCAATACCCAGCCGACCTAGCCCATAAAATACA TAGTGCAAATCATATGGATGATAATGATGGAGAA | 1589 |
| | TTCTCCATCATTATCATCCATATGATTTGCACTATGTATTTTAT GGGCTAGGTCGGCTGGGTATTGACCATAACTGCAAAACTTAC TTTCATCATCTTCAGAATAGGATTCAATCGAGGGT | 1590 |
| | GGTCAATACCCAGCCGA | 1591 |
| | TCGGCTGGGTATTGACC | 1592 |
| Adenomatous polyposis coli Glu1020Term GAA-TAA | TACCCAGCCGACCTAGCCCATAAAATACATAGTGCAAATCATA TGGATGATAATGATGGAGAACTAGATACACCAATAAATTATAG TCTTAAATATTCAGATGAGCAGTTGAACTCTGGAA | 1593 |
| | TTCCAGAGTTCAACTGCTCATCTGAATATTTAAGACTATAATTT ATTGGTGTATCTAGTTCTCCATCATTATCATCCATATGATTTGC- ACTATGTATTTTATGGGCTAGGTCGGCTGGGTA | 1594 |
| | ATGATGGAGAACTAGAT | 1595 |
| | ATCTAGTTCTCCATCAT | 1596 |
| Adenomatous polyposis coli Ser1032Term TCA-TAA | ATGAAACCCTCGATTGAATCCTATTCTGAAGATGATGAAAGTA AGTTTTGCAGTTATGGTCAATACCCAGCCGACCTAGCCCATAA AATACATAGTGCAAATCATATGGATGATAATGATG | 1597 |
| | CATCATTATCATCCATATGATTTGCACTATGTATTTTATGGGCT AGGTCGGCTGGGTATTGACCATAACTGCAAAACTTACTTTCAT CATCTTCAGAATAGGATTCAATCGAGGGTTTCAT | 1598 |

TABLE 18-continued

APC Mutations and Genome-Correcting Oligos

| Clinical Phenotype & Mutation | Correcting oligos | SEQ ID NO: |
|---|---|---|
| | GTTATGGTCAATACCCA | 1599 |
| | TGGGTATTGACCATAAC | 1600 |
| Adenomatous polyposis coli Gln1041Term CAA-TAA | TGAAGATGATGAAAGTAAGTTTTGCAGTTATGGTCAATACCCA GCCGACCTAGCCCATAAAATACATAGTGCAAATCATATGGATG ATAATGATGGAGAACTAGATACACCAATAAATTAT | 1601 |
| | ATAATTTATTGGTGTATCTAGTTCTCCATCATTATCATCCATAT GATTTGCACTATGTATTTTATGGGCTAGGTCGGCTGGGTATTG ACCATAACTGCAAAACTTACTTTCATCATCTTCA | 1602 |
| | GCCCATAAAATACATAG | 1603 |
| | CTATGTATTTTATGGGC | 1604 |
| Adenomatous polyposis coli Gln1045Term CAG-TAG | ATAAATTATAGTCTTAAATATTCAGATGAGCAGTTGAACTCTGG AAGGCAAAGTCCTTCACAGAATGAAAGATGGGCAAGACCCAA ACACATAATAGAAGATGAAATAAAACAAAGTGAGC | 1605 |
| | GCTCACTTTGTTTTATTTCATCTTCTATTATGTGTTTGGGTCTT GCCCATCTTTCATTCTGTGAAGGACTTTGCCTTCCAGAGTTCA ACTGCTCATCTGAATATTTAAGACTATAATTTAT | 1606 |
| | GTCCTTCACAGAATGAA | 1607 |
| | TTCATTCTGTGAAGGAC | 1608 |
| Adenomatous polyposis coli Gln1067Term CAA-TAA | GAAAGATGGGCAAGACCCAAACACATAATAGAAGATGAAATAA AACAAAGTGAGCAAAGACAATCAAGGAATCAAAGTACAACTTA TCCTGTTTATACTGAGAGCACTGATGATAAACACC | 1609 |
| | GGTGTTTATCATCAGTGCTCTCAGTATAAACAGGATAAGTTGT ACTTTGATTCCTTGATTGTCTTTGCTCACTTTGTTTTATTTCATC TTCTATTATGTGTTTGGGTCTTGCCCATCTTTC | 1610 |
| | AGCAAAGACAATCAAGG | 1611 |
| | CCTTGATTGTCTTTGCT | 1612 |
| Adenomatous polyposis coli Tyr1075Term TAT-TAG | AATAGAAGATGAAATAAAACAAAGTGAGCAAAGACAATCAAGG AATCAAAGTACAACTTATCCTGTTTATACTGAGAGCACTGATG ATAAACACCTCAAGTTCCAACCACATTTTGGACAG | 1613 |
| | CTGTCCAAAATGTGGTTGGAACTTGAGGTGTTTATCATCAGTG CTCTCAGTATAAACAGGATAAGTTGTACTTTGATTCCTTGATTG TCTTTGCTCACTTTGTTTTATTTCATCTTCTATT | 1614 |
| | ACAACTTATCCTGTTTA | 1615 |
| | TAAACAGGATAAGTTGT | 1616 |
| Adenomatous polyposis coli Tyr1102Term TAC-TAG | TGATGATAAACACCTCAAGTTCCAACCACATTTTGGACAGCAG GAATGTGTTTCTCCATACAGGTCACGGGGAGCCAATGGTTCA GAAACAAATCGAGTGGGTTCTAATCATGGAATTAAT | 1617 |
| | ATTAATTCCATGATTAGAACCCACTCGATTTGTTTCTGAACCAT TGGCTCCCCGTGACCTGTATGGAGAAACACATTCCTGCTGTC CAAAATGTGGTTGGAACTTGAGGTGTTTATCATCA | 1618 |
| | TCTCCATACAGGTCACG | 1619 |
| | CGTGACCTGTATGGAGA | 1620 |
| Adenomatous polyposis coli Ser1110Term TCA-TGA | AACCACATTTTGGACAGCAGGAATGTGTTTCTCCATACAGGTC ACGGGGAGCCAATGGTTCAGAAACAAATCGAGTGGGTTCTAA TCATGGAATTAATCAAAATGTAAGCCAGTCTTTGTG | 1621 |
| | CACAAAGACTGGCTTACATTTTGATTAATTCCATGATTAGAACC CACTCGATTTGTTTCTGAACCATTGGCTCCCCGTGACCTGTAT GGAGAAACACATTCCTGCTGTCCAAAATGTGGTT | 1622 |

TABLE 18-continued

APC Mutations and Genome-Correcting Oligos

| Clinical Phenotype & Mutation | Correcting oligos | SEQ ID NO: |
|---|---|---|
| | CAATGGTTCAGAAACAA | 1623 |
| | TTGTTTCTGAACCATTG | 1624 |
| Adenomatous polyposis coli Arg1114Term CGA-TGA | GGACAGCAGGAATGTGTTTCTCCATACAGGTCACGGGGAGCC AATGGTTCAGAAACAAATCGAGTGGGTTCTAATCATGGAATTA ATCAAAATGTAAGCCAGTCTTTGTGTCAAGAAGATG | 1625 |
| | CATCTTCTTGACACAAAGACTGGCTTACATTTTGATTAATTCCA TGATTAGAACCCACTCGATTTGTTTCTGAACCATTGGCTCCCC GTGACCTGTATGGAGAAACACATTCCTGCTGTCC | 1626 |
| | AAACAAATCGAGTGGGT | 1627 |
| | ACCCACTCGATTTGTTT | 1628 |
| Adenomatous polyposis coli Tyr1135Term TAT-TAG | GGGTTCTAATCATGGAATTAATCAAAATGTAAGCCAGTCTTTG TGTCAAGAAGATGACTATGAAGATGATAAGCCTACCAATTATA GTGAACGTTACTCTGAAGAAGAACAGCATGAAGAA | 1629 |
| | TTCTTCATGCTGTTCTTCTTCAGAGTAACGTTCACTATAATTGG TAGGCTTATCATCTTCATAGTCATCTTCTTGACACAAAGACTG GCTTACATTTTGATTAATTCCATGATTAGAACCC | 1630 |
| | GATGACTATGAAGATGA | 1631 |
| | TCATCTTCATAGTCATC | 1632 |
| Adenomatous polyposis coli Gln1152Term CAG-TAG | GAAGATGACTATGAAGATGATAAGCCTACCAATTATAGTGAAC GTTACTCTGAAGAAGAACAGCATGAAGAAGAAGAGAGACCAA CAAATTATAGCATAAAATATAATGAAGAGAAACGTC | 1633 |
| | GACGTTTCTCTTCATTATATTTTATGCTATAATTTGTTGGTCTCT CTTCTTCTTCATGCTGTTCTTCTTCAGAGTAACGTTCACTATAA TTGGTAGGCTTATCATCTTCATAGTCATCTTC | 1634 |
| | AAGAAGAACAGCATGAA | 1635 |
| | TTCATGCTGTTCTTCTT | 1636 |
| Adenomatous polyposis coli Gln1175Term CAG-TAG | GAAGAAGAGAGACCAACAAATTATAGCATAAAATATAATGAAG AGAAACGTCATGTGGATCAGCCTATTGATTATAGTTTAAAATAT GCCACAGATATTCCTTCATCACAGAAACAGTCAT | 1637 |
| | ATGACTGTTTCTGTGATGAAGGAATATCTGTGGCATATTTTAAA CTATAATCAATAGGCTGATCCACATGACGTTTCTCTTCATTATA TTTTATGCTATAATTTGTTGGTCTCTCTTCTTC | 1638 |
| | ATGTGGATCAGCCTATT | 1639 |
| | AATAGGCTGATCCACAT | 1640 |
| Adenomatous polyposis coli Pro1176Leu CCT-CTT | AAGAGAGACCAACAAATTATAGCATAAAATATAATGAAGAGAA ACGTCATGTGGATCAGCCTATTGATTATAGTTTAAAATATGCCA CAGATATTCCTTCATCACAGAAACAGTCATTTTC | 1641 |
| | GAAAATGACTGTTTCTGTGATGAAGGAATATCTGTGGCATATT TTAAACTATAATCAATAGGCTGATCCACATGACGTTTCTCTTCA TTATATTTTATGCTATAATTTGTTGGTCTCTCTT | 1642 |
| | GGATCAGCCTATTGATT | 1643 |
| | AATCAATAGGCTGATCC | 1644 |
| Adenomatous polyposis coli Ala1184Pro GCC-CCC | ATAAAATATAATGAAGAGAAACGTCATGTGGATCAGCCTATTG ATTATAGTTTAAAATATGCCACAGATATTCCTTCATCACAGAAA CAGTCATTTTCATTCTCAAAGAGTTCATCTGGAC | 1645 |
| | GTCCAGATGAACTCTTTGAGAATGAAAATGACTGTTTCTGTGA TGAAGGAATATCTGTGGCATATTTTAAACTATAATCAATAGGCT GATCCACATGACGTTTCTCTTCATTATATTTTAT | 1646 |

TABLE 18-continued

APC Mutations and Genome-Correcting Oligos

| Clinical Phenotype & Mutation | Correcting oligos | SEQ ID NO: |
|---|---|---|
| | TAAAATATGCCACAGAT | 1647 |
| | ATCTGTGGCATATTTTA | 1648 |
| Adenomatous polyposis coli Ser1194Term TCA-TGA | ATCAGCCTATTGATTATAGTTTAAAATATGCCACAGATATTCCT TCATCACAGAAACAGTCATTTTCATTCTCAAAGAGTTCATCTG GACAAAGCAGTAAAACCGAACATATGTCTTCAAG | 1649 |
| | CTTGAAGACATATGTTCGGTTTTACTGCTTTGTCCAGATGAAC TCTTTGAGAATGAAAATGACTGTTTCTGTGATGAAGGAATATCT GTGGCATATTTTAAACTATAATCAATAGGCTGAT | 1650 |
| | GAAACAGTCATTTTCAT | 1651 |
| | ATGAAAATGACTGTTTC | 1652 |
| Adenomatous polyposis coli Ser1198Term TCA-TGA | ATTATAGTTTAAAATATGCCACAGATATTCCTTCATCACAGAAA CAGTCATTTTCATTCTCAAAGAGTTCATCTGGACAAAGCAGTA AAACCGAACATATGTCTTCAAGCAGTGAGAATAC | 1653 |
| | GTATTCTCACTGCTTGAAGACATATGTTCGGTTTTACTGCTTTG TCCAGATGAACTCTTTGAGAATGAAAATGACTGTTTCTGTGAT GAAGGAATATCTGTGGCATATTTTAAACTATAAT | 1654 |
| | TTCATTCTCAAAGAGTT | 1655 |
| | AACTCTTTGAGAATGAA | 1656 |
| Adenomatous polyposis coli Gln1228Term CAG-TAG | ACCGAACATATGTCTTCAAGCAGTGAGAATACGTCCACACCTT CATCTAATGCCAAGAGGCAGAATCAGCTCCATCCAGTTCTGC ACAGAGTAGAAGTGGTCAGCCTCAAAGGCTGCCACT | 1657 |
| | AGTGGCAGCCTTTGAGGCTGACCACTTCTACTCTGTGCAGAA CTGGATGGAGCTGATTCTGCCTCTTGGCATTAGATGAAGGTG TGGACGTATTCTCACTGCTTGAAGACATATGTTCGGT | 1658 |
| | CCAAGAGGCAGAATCAG | 1659 |
| | CTGATTCTGCCTCTTGG | 1660 |
| Adenomatous polyposis coli Gln1230Term CAG-TAG | CATATGTCTTCAAGCAGTGAGAATACGTCCACACCTTCATCTA ATGCCAAGAGGCAGAATCAGCTCCATCCAGTTCTGCACAGAG TAGAAGTGGTCAGCCTCAAAGGCTGCCACTTGCAAG | 1661 |
| | CTTGCAAGTGGCAGCCTTTGAGGCTGACCACTTCTACTCTGT GCAGAACTGGATGGAGCTGATTCTGCCTCTTGGCATTAGATG AAGGTGTGGACGTATTCTCACTGCTTGAAGACATATG | 1662 |
| | GGCAGAATCAGCTCCAT | 1663 |
| | ATGGAGCTGATTCTGCC | 1664 |
| Adenomatous polyposis coli Cys1249Term TGC-TGA | TCAGCTCCATCCAAGTTCTGCACAGAGTAGAAGTGGTCAGCC TCAAAAGGCTGCCACTTGCAAAGTTTCTTCTATTAACCAAGAA ACAATACAGACTTATTGTGTAGAAGATACTCCAATA | 1665 |
| | TATTGGAGTATCTTCTACACAATAAGTCTGTATTGTTTCTTGGT TAATAGAAGAAACTTTGCAAGTGGCAGCCTTTTGAGGCTGACC ACTTCTACTCTGTGCAGAACTTGGATGGAGCTGA | 1666 |
| | GCCACTTGCAAAGTTTC | 1667 |
| | GAAACTTTGCAAGTGGC | 1668 |
| Adenomatous polyposis coli Cys1270Term TGT-TGA | AGTTTCTTCTATTAACCAAGAAACAATACAGACTTATTGTGTAG AAGATACTCCAATATGTTTTTCAAGATGTAGTTCATTATCATCT TTGTCATCAGCTGAAGATGAAATAGGATGTAAT | 1669 |
| | ATTACATCCTATTTCATCTTCAGCTGATGACAAAGATGATAATG AACTACATCTTGAAAAACATATTGGAGTATCTTCTACACAATAA GTCTGTATTGTTTCTTGGTTAATAGAAGAAACT | 1670 |

TABLE 18-continued

APC Mutations and Genome-Correcting Oligos

| Clinical Phenotype & Mutation | Correcting oligos | SEQ ID NO: |
| --- | --- | --- |
| | CCAATATGTTTTTCAAG | 1671 |
| | CTTGAAAAACATATTGG | 1672 |
| Adenomatous polyposis coli Ser1276Term TCA-TGA | AAGAAACAATACAGACTTATTGTGTAGAAGATACTCCAATATGT TTTTCAAGATGTAGTTCATTATCATCTTTGTCATCAGCTGAAGA TGAAATAGGATGTAATCAGACGACACAGGAAGC | 1673 |
| | GCTTCCTGTGTCGTCTGATTACATCCTATTTCATCTTCAGCTG ATGACAAAGATGATAATGAACTACATCTTGAAAAACATATTGGA GTATCTTCTACACAATAAGTCTGTATTGTTTCTT | 1674 |
| | ATGTAGTTCATTATCAT | 1675 |
| | ATGATAATGAACTACAT | 1676 |
| Adenomatous polyposis coli Glu1286Term GAA-TAA | GATACTCCAATATGTTTTTCAAGATGTAGTTCATTATCATCTTT GTCATCAGCTGAAGATGAAATAGGATGTAATCAGACGACACA GGAAGCAGATTCTGCTAATACCCTGCAAATAGCAG | 1677 |
| | CTGCTATTTGCAGGGTATTAGCAGAATCTGCTTCCTGTGTCGT CTGATTACATCCTATTTCATCTTCAGCTGATGACAAAGATGATA ATGAACTACATCTTGAAAAACATATTGGAGTATC | 1678 |
| | CTGAAGATGAAATAGGA | 1679 |
| | TCCTATTTCATCTTCAG | 1680 |
| Adenomatous polyposis coli Gln1294Term CAG-TAG | TGTAGTTCATTATCATCTTTGTCATCAGCTGAAGATGAAATAGG ATGTAATCAGACGACACAGGAAGCAGATTCTGCTAATACCCTG CAAATAGCAGAAATAAAAGAAAAGATTGGAACTA | 1681 |
| | TAGTTCCAATCTTTTCTTTTATTTCTGCTATTTGCAGGGTATTA GCAGAATCTGCTTCCTGTGTCGTCTGATTACATCCTATTTCAT CTTCAGCTGATGACAAAGATGATAATGAACTACA | 1682 |
| | AGACGACACAGGAAGCA | 1683 |
| | TGCTTCCTGTGTCGTCT | 1684 |
| Predisposition to, association with, colorectal cancer Ile1307Lys ATA-AAA | TAGGATGTAATCAGACGACACAGGAAGCAGATTCTGCTAATAC CCTGCAAATAGCAGAAATAAAAGAAAAGATTGGAACTAGGTCA GCTGAAGATCCTGTGAGCGAAGTTCCAGCAGTGTC | 1685 |
| | GACACTGCTGGAACTTCGCTCACAGGATCTTCAGCTGACCTA GTTCCAATCTTTTCTTTTATTTCTGCTATTTGCAGGGTATTAGC AGAATCTGCTTCCTGTGTCGTCTGATTACATCCTA | 1686 |
| | AGCAGAAATAAAAGAAA | 1687 |
| | TTTCTTTTATTTCTGCT | 1688 |
| Adenomatous polyposis coil Glu1309Term GAA-TAA | CCAAGAAACAATACAGACTTATTGTGTAGAAGATACTCCAATA TGTTTTTCAAGATGTAGTTCATTATCATCTTTGTCATCAGCTGA AGATGAAATAGGATGTAATCAGACGACACAGGAA | 1689 |
| | TTCCTGTGTCGTCTGATTACATCCTATTTCATCTTCAGCTGATG ACAAAGATGATAATGAACTACATCTTGAAAAACATATTGGAGTA TCTTCTACACAATAAGTCTGTATTGTTTCTTGG | 1690 |
| | AGATGTAGTTCATTATC | 1691 |
| | GATAATGAACTACATCT | 1692 |
| Predisposition to Colorectal Cancer Glu1317Gln GAA-CAA | GATTCTGCTAATACCCTGCAAATAGCAGAAATAAAAGAAAAGA TTGGAACTAGGTCAGCTGAAGATCCTGTGAGCGAAGTTCCAG CAGTGTCACAGCACCCTAGAACCAAATCCAGCAGAC | 1693 |
| | GTCTGCTGGATTTGGTTCTAGGGTGCTGTGACACTGCTGGAA CTTCGCTCACAGGATCTTCAGCTGACCTAGTTCCAATCTTTTC TTTTATTTCTGCTATTTGCAGGGTATTAGCAGAATC | 1694 |

TABLE 18-continued

APC Mutations and Genome-Correcting Oligos

| Clinical Phenotype & Mutation | Correcting oligos | SEQ ID NO: |
|---|---|---|
| | GGTCAGCTGAAGATCCT | 1695 |
| | AGGATCTTCAGCTGACC | 1696 |
| Adenomatous polyposis coli Gln1328Term CAG-TAG | AAAGAAAAGATTGGAACTAGGTCAGCTGAAGATCCTGTGAGC GAAGTTCCAGCAGTGTCACAGCACCCTAGAACCAAATCCAGC AGACTGCAGGGTTCTAGTTTATCTTCAGAATCAGCCA | 1697 |
| | TGGCTGATTCTGAAGATAAACTAGAACCCTGCAGTCTGCTGG ATTTGGTTCTAGGGTGCTGTGACACTGCTGGAACTTCGCTCA CAGGATCTTCAGCTGACCTAGTTCCAATCTTTTCTTT | 1698 |
| | CAGTGTCACAGCACCCT | 1699 |
| | AGGGTGCTGTGACACTG | 1700 |
| Adenomatous polyposis coli Gln1338Term CAG-TAG | GATCCTGTGAGCGAAGTTCCAGCAGTGTCACAGCACCCTAGA ACCAAATCCAGCAGACTGCAGGGTTCTAGTTTATCTTCAGAAT CAGCCAGGCACAAAGCTGTTGAATTTTCTTCAGGAG | 1701 |
| | CTCCTGAAGAAAATTCAACAGCTTTGTGCCTGGCTGATTCTGA AGATAAACTAGAACCCTGCAGTCTGCTGGATTTGGTTCTAGG GTGCTGTGACACTGCTGGAACTTCGCTCACAGGATC | 1702 |
| | GCAGACTGCAGGGTTCT | 1703 |
| | AGAACCCTGCAGTCTGC | 1704 |
| Adenomatous polyposis coli Leu1342Term TTA-TAA | AAGTTCCAGCAGTGTCACAGCACCCTAGAACCAAATCCAGCA GACTGCAGGGTTCTAGTTTATCTTCAGAATCAGCCAGGCACAA AGCTGTTGAATTTTCTTCAGGAGCGAAATCTCCCTC | 1705 |
| | GAGGGAGATTTCGCTCCTGAAGAAAATTCAACAGCTTTGTGC CTGGCTGATTCTGAAGATAAACTAGAACCCTGCAGTCTGCTG GATTTGGTTCTAGGGTGCTGTGACACTGCTGGAACTT | 1706 |
| | TTCTAGTTTATCTTCAG | 1707 |
| | CTGAAGATAAACTAGAA | 1708 |
| Adenomatous polyposis coli Arg1348Trp AGG-TGG | CAGCACCCTAGAACCAAATCCAGCAGACTGCAGGGTTCTAGT TTATCTTCAGAATCAGCCAGGCACAAAGCTGTTGAATTTTCTT CAGGAGCGAAATCTCCCTCCCGAAAGTGGTGCTCAG | 1709 |
| | CTGAGCACCACTTTCGGGAGGGAGATTTCGCTCCTGAAGAAA ATTCAACAGCTTTGTGCCTGGCTGATTCTGAAGATAAACTAGA ACCCTGCAGTCTGCTGGATTTGGTTCTAGGGTGCTG | 1710 |
| | AATCAGCCAGGCACAAA | 1711 |
| | TTTGTGCCTGGCTGATT | 1712 |
| Adenomatous polyposis coli Gly1357Term GGA-TGA | CTGCAGGGTTCTAGTTTATCTTCAGAATCAGCCAGGCACAAAG CTGTTGAATTTTCTTCAGGAGCGAAATCTCCCTCCCGAAAGTG GTGCTCAGACACCCCAAAGTCCACCTGAACACTAT | 1713 |
| | ATAGTGTTCAGGTGGACTTTGGGGTGTCTGAGCACCACTTTC GGGAGGGAGATTTCGCTCCTGAAGAAAATTCAACAGCTTTGT GCCTGGCTGATTCTGAAGATAAACTAGAACCCTGCAG | 1714 |
| | TTTCTTCAGGAGCGAAA | 1715 |
| | TTTCGCTCCTGAAGAAA | 1716 |
| Adenomatous polyposis coli Gln1367Term CAG-TAG | CCAGGCACAAAGCTGTTGAATTTTCTTCAGGAGCGAAATCTCC CTCCCGAAAGTGGTGCTCAGACACCCCAAAGTCCACCTGAAC ACTATGTTCAGGAGACCCCACTCATGTTTAGCAGAT | 1717 |
| | ATCTGCTAAACATGAGTGGGGTCTCCTGAACATAGTGTTCAG GTGGACTTTGGGGTGTCTGAGCACCACTTTCGGGAGGGAGAT TTCGCTCCTGAAGAAAATTCAACAGCTTTGTGCCTGG | 1718 |

TABLE 18-continued

APC Mutations and Genome-Correcting Oligos

| Clinical Phenotype & Mutation | Correcting oligos | SEQ ID NO: |
|---|---|---|
| | GTGGTGCTCAGACACCC | 1719 |
| | GGGTGTCTGAGCACCAC | 1720 |
| Adenomatous polyposis coli Lys1370Term AAA-TAA | AAAGCTGTTGAATTTTCTTCAGGAGCGAAATCTCCCTCCAAAA GTGGTGCTCAGACACCCAAAAGTCCACCTGAACACTATGTTC AGGAGACCCCACTCATGTTTAGCAGATGTACTTCTG | 1721 |
| | CAGAAGTACATCTGCTAAACATGAGTGGGGTCTCCTGAACATA GTGTTCAGGTGGACTTTTGGGTGTCTGAGCACCACTTTTGGA GGGAGATTTCGCTCCTGAAGAAAATTCAACAGCTTT | 1722 |
| | AGACACCCAAAAGTCCA | 1723 |
| | TGGACTTTTGGGTGTCT | 1724 |
| Adenomatous polyposis coli Ser1392Term TCA-TAA | CACCTGAACACTATGTTCAGGAGACCCCACTCATGTTTAGCA GATGTACTTCTGTCAGTTCACTTGATAGTTTTGAGAGTCGTTC GATTGCCAGCTCCGTTCAGAGTGAACCATGCAGTGG | 1725 |
| | CCACTGCATGGTTCACTCTGAACGGAGCTGGCAATCGAACGA CTCTCAAAACTATCAAGTGAACTGACAGAAGTACATCTGCTAA ACATGAGTGGGGTCTCCTGAACATAGTGTTCAGGTG | 1726 |
| | TGTCAGTTCACTTGATA | 1727 |
| | TATCAAGTGAACTGACA | 1728 |
| Adenomatous polyposis coli Ser1392Term TCA-TGA | CACCTGAACACTATGTTCAGGAGACCCCACTCATGTTTAGCA GATGTACTTCTGTCAGTTCACTTGATAGTTTTGAGAGTCGTTC GATTGCCAGCTCCGTTCAGAGTGAACCATGCAGTGG | 1729 |
| | CCACTGCATGGTTCACTCTGAACGGAGCTGGCAATCGAACGA CTCTCAAAACTATCAAGTGAACTGACAGAAGTACATCTGCTAA ACATGAGTGGGGTCTCCTGAACATAGTGTTCAGGTG | 1730 |
| | TGTCAGTTCACTTGATA | 1731 |
| | TATCAAGTGAACTGACA | 1732 |
| Adenomatous polyposis coli Glu1397Term GAG-TAG | GTTCAGGAGACCCCACTCATGTTTAGCAGATGTACTTCTGTCA GTTCACTTGATAGTTTTGAGAGTCGTTCGATTGCCAGCTCCGT TCAGAGTGAACCATGCAGTGGAATGGTAGGTGGCA | 1733 |
| | TGCCACCTACCATTCCACTGCATGGTTCACTCTGAACGGAGC TGGAATCGAACGACTCTCAAAACTATCAAGTGAACTGACAGA AGTACATCTGCTAAACATGAGTGGGGTCTCCTGAAC | 1734 |
| | ATAGTTTTGAGAGTCGT | 1735 |
| | ACGACTCTCAAAACTAT | 1736 |
| Adenomatous polyposis coli Lys1449Term AAG-TAG | CAAACCATGCCACCAAGCAGAAGTAAAACACCTCCACCACCT CCTCAAACAGCTCAAACCAAGCGAGAAGTACCTAAAAATAAAG CACCTACTGCTGAAAAGAGAGAGAGTGGACCTAAGC | 1737 |
| | GCTTAGGTCCACTCTCTCTCTTTTCAGCAGTAGGTGCTTTATT TTTAGGTACTTCTCGCTTGGTTTGAGCTGTTTGAGGAGGTGGT GGAGGTGTTTTACTTCTGCTTGGTGGCATGGTTTG | 1738 |
| | CTCAAACCAAGCGAGAA | 1739 |
| | TTCTCGCTTGGTTTGAG | 1740 |
| Adenomatous polyposis coli Arg1450Term CGA-TGA | ACCATGCCACCAAGCAGAAGTAAAACACCTCCACCACCTCCT CAAACAGCTCAAACCAAGCGAGAAGTACCTAAAAATAAAGCAC CTACTGCTGAAAAGAGAGAGAGTGGACCTAAGCAAG | 1741 |
| | CTTGCTTAGGTCCACTCTCTCTCTTTTCAGCAGTAGGTGCTTT ATTTTTAGGTACTTCTCGCTTGGTTTGAGCTGTTTGAGGAGGT GGTGGAGGTGTTTTACTTCTGCTTGGTGGCATGGT | 1742 |

TABLE 18-continued

APC Mutations and Genome-Correcting Oligos

| Clinical Phenotype & Mutation | Correcting oligos | SEQ ID NO: |
|---|---|---|
| | AAACCAAGCGAGAAGTA | 1743 |
| | TACTTCTCGCTTGGTTT | 1744 |
| Adenomatous polyposis coli SeR1503Term TCA-TAA | CAGATGCTGATACTTTATTACATTTTGCCACGGAAAGTACTCC AGATGGATTTTCTTGTTCATCCAGCCTGAGTGCTCTGAGCCTC GATGAGCCATTTATACAGAAAGATGTGGAATTAAG | 1145 |
| | CTTAATTCCACATCTTTCTGTATAAATGGCTCATCGAGGCTCA GAGCACTCAGGCTGGATGAACAAGAAAATCCATCTGGAGTAC TTTCCGTGGCAAAATGTAATAAAGTATCAGCATCTG | 1746 |
| | TTCTTGTTCATCCAGCC | 1747 |
| | GGCTGGATGAACAAGAA | 1748 |
| Adenomatous polyposis coli Gln1529Term CAG-TAG | CTGAGCCTCGATGAGCCATTTATACAGAAAGATGTGGAATTAA GAATAATGCCTCCAGTTCAGGAAAATGACAATGGGAATGAAAC AGAATCAGAGCAGCCTAAAGAATCAAATGAAAACC | 1749 |
| | GGTTTTCATTTGATTCTTTAGGCTGCTCTGATTCTGTTTCATTC CCATTGTCATTTTCCTGAACTGGAGGCATTATTCTTAATTCCAC ATCTTTCTGTATAAATGGCTCATCGAGGCTCAG | 1750 |
| | CTCCAGTTCAGGAAAAT | 1751 |
| | ATTTTCCTGAACTGGAG | 1752 |
| Adenomatous polyposis coli Ser1539Term TCA-TAA | ATGTGGAATTAAGAATAATGCCTCCAGTTCAGGAAAATGACAA TGGGAATGAAACAGAATCAGAGCAGCCTAAAGAATCAAATGAA AACCAAGAGAAAGAGGCAGAAAAAACTATTGATTC | 1753 |
| | GAATCAATAGTTTTTTCTGCCTCTTTCTCTTGGTTTTCATTTGA TTCTTTAGGCTGCTCTGATTCTGTTTCATTCCCATTGTCATTTT CCTGAACTGGAGGCATTATTCTTAATTCCACAT | 1754 |
| | AACAGAATCAGAGCAGC | 1755 |
| | GCTGCTCTGATTCTGTT | 1756 |
| Adenomatous polyposis coli Ser1567Term TCA-TGA | AAAACCAAGAGAAAGAGGCAGAAAAAACTATTGATTCTGAAAA GGACCTATTAGATGATTCAGATGATGATGATATTGAAATACTA GAAGAATGTATTATTTCTGCCATGCCAACAAAGTC | 1757 |
| | GACTTTGTTGGCATGGCAGAAATAATACATTCTTCTAGTATTTC AATATCATCATCATCTGAATCATCTAATAGGTCCTTTTCAGAAT CAATAGTTTTTTCTGCCTCTTTCTCTTGGTTTT | 1758 |
| | AGATGATTCAGATGATG | 1759 |
| | CATCATCTGAATCATCT | 1760 |
| Adenomatous poiyposis coli Asp1822Val GAC-GTC | AGAGAGTTTTCTCAGACAACAAAGATTCAAAGAAACAGAATTT GAAAAATAATTCCAAGGACTTCAATGATAAGCTCCCAAATAAT GAAGATAGAGTCAGAGGAAGTTTTGCTTTTGATTC | 1761 |
| | GAATCAAAAGCAAAACTTCCTCTGACTCTATCTTCATTATTTGG GAGCTTATCATTGAAGTCCTTGGAATTATTTTTCAAATTCTGTT TCTTTGAATCTTTGTTGTCTGAGAAAACTCTCT | 1762 |
| | TTCCAAGGACTTCAATG | 1763 |
| | CATTGAAGTCCTTGGAA | 1764 |
| Adenomatous polyposis coli Leu2839Phe CTT-TTT | AAAACTGACAGCACAGAATCCAGTGGAACCCAAAGTCCTAAG CGCCATTCTGGGTCTTACCTTGTGACATCTGTTTAAAAGAGAG GAAGAATGAAACTAAGAAAATTCTATGTTAATTACA | 1765 |
| | TGTAATTAACATAGAATTTTCTTAGTTTCATTCTTCCTCTCTTTT AAACAGATGTCACAAGGTAAGACCCAGAATGGCGCTTAGGAC TTTGGGTTCCACTGGATTCTGTGCTGTCAGTTTT | 1766 |

TABLE 18-continued

APC Mutations and Genome-Correcting Oligos

| Clinical Phenotype & Mutation | Correcting oligos | SEQ ID NO: |
|---|---|---|
| | GGTCTTACCTTGTGACA | 1767 |
| | TGTCACAAGGTAAGACC | 1768 |

EXAMPLE 12

Parahemophilia—Factor V Deficiency

Deficiency in clotting Factor V is associated with a lifelong predisposition to thrombosis. The disease typically manifests itself with usually mild bleeding, although bleeding times and clotting times are consistently prolonged. Individuals that are heterozygous for a mutation in Factor V have lowered levels of factor V but probably never have abnormal bleeding. A large number of alleles with a range of presenting symptoms have been identified. The attached table discloses the correcting oligonucleotide base sequences for the Factor V oligonucleotides of the invention.

TABLE 19

Factor V Mutations and Genome-Correcting Oligos

| Clinical Phenotype & Mutation | Correcting Oligos | SEQ ID NO: |
|---|---|---|
| Factor V deficiency Ala221Val GCC-GTC | TTGACTGAATGCTTATTTTGGCCTGTGTCTCTCCCTCTTTCTCA GATATAACAGTTTGTGCCCATGACCACATCAGCTGGCATCTGC TGGGAATGAGCTCGGGGCCAGAATTATTCTCCAT | 4340 |
| | ATGGAGAATAATTCTGGCCCCGAGCTCATTCCCAGCAGATGC CAGCTGATGTGGTCATGGGCACAAACTGTTATATCTGAGAAAG AGGGAGAGACACAGGCCAAAATAAGCATTCAGTCAA | 1769 |
| | AGTTTGTGCCCATGACC | 1770 |
| | GGTCATGGGCACAAACT | 1771 |
| Thrombosis Arg306Gly AGG-GGG | TGTCCTAACTCAGCTGGGATGCAGGCTTACATTGACATTAAAA ACTGCCCAAAGAAAACCAGGAATCTTAAGAAAATAACTCGTGA GCAGAGGCGGCACATGAAGAGGTGGGAATACTTCA | 1712 |
| | TGAAGTATTCCCACCTCTTCATGTGCCGCCTCTGCTCACGAGT TATTTTCTTAAGATTCCTGGTTTTCTTTGGGCAGTTTTTAATGT CAATGTAAGCCTGCATCCCAGCTGAGTTAGGACA | 1773 |
| | AGAAAACCAGGAATCTT | 1774 |
| | AAGATTCCTGGTTTTCT | 1775 |
| Thrombosis Arg306Thr AGG-ACG | GTCCTAACTCAGCTGGGATGCAGGCTTACATTGACATTAAAAA CTGCCCAAAGAAAACCAGGAATCTTAAGAAAATAACTCGTGAG CAGAGGCGGCACATGAAGAGGTGGGAATACTTCAT | 1776 |
| | ATGAAGTATTCCCACCTCTTCATGTGCCGCCTCTGCTCACGA GTTATTTTCTTAAGATTCCTGGTTTTCTTTGGGCAGTTTTTAAT GTCAATGTAAGCCTGCATCCCAGCTGAGTTAGGAC | 1777 |
| | GAAAACCAGGAATCTTA | 1778 |
| | TAAGATTCCTGGTTTTC | 1779 |
| Increased Risk Thrombosis Arg485Lys AGA-AAA | CCACAGAAAATGATGCCCAGTGCTTAACAAGACCATACTACAG TGACGTGGACATCATGAGAGACATCGCCTCTGGGCTAATAGG ACTACTTCTAATCTGTAAGAGCAGATCCCTGGACAG | 1780 |
| | CTGTCCAGGGATCTGCTCTTACAGATTAGAAGTAGTCCTATTA GCCCAGAGGCGATGTCTCTCATGATGTCCACGTCACTGTAGT ATGGTCTTGTTAAGCACTGGGCATCATTTTCTGTGG | 1781 |
| | CATCATGAGAGACATCG | 1782 |
| | CGATGTCTCTCATGATG | 1783 |

TABLE 19-continued

Factor V Mutations and Genome-Correcting Oligos

| Clinical Phenotype & Mutation | Correcting Oligos | SEQ ID NO: |
|---|---|---|
| Increased Risk Thrombosis Arg506Gln CGA-CAA | ACATCGCCTCTGGGCTAATAGGACTACTTCTAATCTGTAAGAG CAGATCCCTGGACAGGCGAGGAATACAGGTATTTTGTCCTTG AAGTAACCTTTCAGAAATTCTGAGAATTTCTTCTGG | 1784 |
| | CCAGAAGAAATTCTCAGAATTTCTGAAAGGTTACTTCAAGGAC AAAATACCTGTATTCCTCGCCTGTCCAGGGATCTGCTCTTACA GATTAGAAGTAGTCCTATTAGCCCAGAGGCGATGT | 1785 |
| | GGACAGGCGAGGAATAC | 1786 |
| | GTATTCCTCGCCTGTCC | 1787 |
| Factor V Deficiency Arg506Term CGA-TGA | GACATCGCCTCTGGGCTAATAGGACTACTTCTAATCTGTAAGA GCAGATCCCTGGACAGGCCGAGGAATACAGGTATTTTGTCCTT GAAGTAACCTTTCAGAAATTCTGAGAATTTCTTCTG | 1788 |
| | CAGAAGAAATTCTCAGAATTTCTGAAAGGTTACTTCAAGGACA AAATACCTGTATTCCTCGCCTGTCCAGGGATCTGCTCTTACAG ATTAGAAGTAGTCCTATTAGCCCAGAGGCGATGTC | 1789 |
| | TGGACAGGCGAGGAATA | 1790 |
| | TATTCCTCGCCTGTCCA | 1791 |
| Thrombosis Arg712Term CGA-TGA | AGTGATGCTGACTATGATTACCAGAACAGACTGGCTGCAGCA TTAGGAATCAGGTCATTCCGAAACTCATCATTGAATCAGGAAG AAGAAGAGTTCAATCTTACTGCCCTAGCTCTGGAGA | 1792 |
| | TCTCCAGAGCTAGGGCAGTAAGATTGAACTCTTCTTCTTCCTG ATTCAATGATGAGTTTCGGAATGACCTGATTCCTAATGCTGCA GCCAGTCTGTTCTGGTAATCATAGTCAGCATCACT | 1793 |
| | GGTCATTCCGAAACTCA | 1794 |
| | TGAGTTTCGGAATGACC | 1795 |
| Thrombosis His1299Arg CAT-CGT | TCAGTCAGACAAACCTTTCCCCAGCCCTCGGTCAGATGCCCA TTTCTCCAGACCTCAGCCATACAACCCTTTCTCTAGACTTCAG CCAGACAAACCTCTCTCCAGAACTCAGTCAAACAAA | 1796 |
| | TTTGTTTGACTGAGTTCTGGAGAGAGGTTTGTCTGGCTGAAGT CTAGAGAAAGGGTTGTATGGTCTGGAGAAATGGGCA TCTGACCGAGGGCTGGGGAAAGGTTTGTCTGACTGA | 1797 |
| | CCTCAGCCATACAACCC | 1798 |
| | GGGTTGTATGGCTGAGG | 1799 |

EXAMPLE 13

Hemophilia—Factor VIII Deficiency

The attached table discloses the correcting oligonucleotide base sequences for the Factor VIII oligonucleotides of the invention.

TABLE 20

Factor VIII Mutations and Genome-Correcting Oligos

| Clinical Phenotype & Mutation | Correcting Oligos | SEQ ID NO: |
|---|---|---|
| Haemophilia A Tyr5Cys TAC-TGC | AGCTCTCCACCTGCTTCTTTCTGTGCCTTTTGCGATTCTGCTT TAGTGCCACCAGAAGATACTACCTGGGTGCAGTGGAACTGTC ATGGGACTATATGCAAAGTGATCTCGGTGAGCTGCC | 1800 |
| | GGCAGCTCACCGAGATCACTTTGCATATAGTCCCATGACAGT | 1801 |

TABLE 20-continued

Factor VIII Mutations and Genome-Correcting Oligos

| Clinical Phenotype & Mutation | Correcting Oligos | SEQ ID NO: |
|---|---|---|
| | TCCACTGCACCCAGGTAGTATCTTCTGGTGGCACTAAAGCAG AATCGCAAAAGGCACAGAAAGAAGCAGGTGGAGAGCT | |
| | CAGAAGATACTACCTGG | 1802 |
| | CCAGGTAGTATCTTCTG | 1803 |
| Haemophilia A Leu7Arg CTG-CGG | CCACCTGCTTCTTTCTGTGCCTTTTGCGATTCTGCTTTAGTGC CACCAGAAGATACTACCTGGGTGCAGTGGAACTGTCATGGGA CTATATGCAAAGTGATCTCGGTGAGCTGCCTGTGGA | 1804 |
| | TCCACAGGCAGCTCACCGAGATCACTTTGCATATAGTCCCAT GACAGTTCCACTGCACCCAGGTAGTATCTTCTGGTGGCACTA AAGCAGAATCGCAAAAGGCACAGAAAGAAGCAGGTGG | 1805 |
| | ATACTACCTGGGTGCAG | 1806 |
| | CTGCACCCAGGTAGTAT | 1807 |
| Haemophilia A Ser(-1)Arg AGTg-AGG | AGTCATGCAAATAGAGCTCTCCACCTGCTTCTTTCTGTGCCTT TTGCGATTCTGCTTTAGTGCCACCAGAAGATACTACCTGGGT GCAGTGGAACTGTCATGGGACTATATGCAAAGTGAT | 1808 |
| | ATCACTTTGCATATAGTCCCATGACAGTTCCACTGCACCCAG GTAGTATCTTCTGGTGGCACTAAAGCAGAATCGCAAAAGGCA CAGAAAGAAGCAGGTGGAGAGCTCTATTTGCATGACT | 1809 |
| | TGCTTTAGTGCCACCAG | 1810 |
| | CTGGTGGCACTAAAGCA | 1811 |
| Haemophilia A Arg(-5)Term gCGA-TGA | CATTTGTAGCAAATAAGTCATGCAAATAGAGCTCTCCACCTGCT TCTTTCTGTGCCTTTTGCGATTCTGCTTTAGTGCCACCAGAAG ATACTACCTGGGTGCAGTGGAACTGTCATGGGACT | 1812 |
| | AGTCCCATGACAGTTCCACTGCACCCAGGTAGTATCTTCTGG TGGCACTAAAGCAGAATCGCAAAAGGCACAGAAAGAAGCAGG TGGAGAGCTCTATTTGCATGACTTATTGCTACAAATG | 1813 |
| | GCCTTTTGCGATTCTGC | 1814 |
| | GCAGAATCGCAAAAGGC | 1815 |
| Haemophilia A Glu11Val GAA-GTA | TTCTGTGCCTTTTGCGATTCTGCTTTAGTGCCACCAGAAGATA CTACCTGGGTGCAGTGGAACTGTCATGGGACTATATGCAAAG TGATCTCGGTGAGCTGCCTGTGGACGCAAGGTAAAG | 1816 |
| | CTTTACCTTGCGTCCACAGGCAGCTCACCGAGATCACTTTGC ATATAGTCCCATGACAGTTCCACTGCACCCAGGTAGTATCTTC TGGTGGCACTAAAGCAGAATCGCAAAAGGCACAGAA | 1817 |
| | TGCAGTGGAACTGTCAT | 1818 |
| | ATGACAGTTCCACTGCA | 1819 |
| Haemophilia A Trp14Gly aTGG-GGG | CTTTTGCGATTCTGCTTTAGTGCCACCAGAAGATACTACCTGG GTGCAGTGGAACTGTCATGGGACTATATGCAAAGTGATCTCG GTGAGCTGCCTGTGGACGCAAGGTAAAGGCATGTCC | 1820 |
| | GGACATGCCTTTACCTTGCGTCCACAGGCAGCTCACCGAGAT CACTTTGCATATAGTCCCATGACAGTTCCACTGCACCCAGGT AGTATCTTCTGGTGGCACTAAAGCAGAATCGCAAAAG | 1821 |
| | AACTGTCATGGGACTAT | 1822 |
| | ATAGTCCCATGACAGTT | 1823 |
| Haemophilia A Tyr46Term TACa-TAA | TTCACGCAGATTTCCTCCTAGAGTGCCAAAATCTTTTCCATTC AACACCTCAGTCGTGTACAAAAAGACTCTGTTTGTAGAATTCA CGGATCACCTTTTCAACATCGCTAAGCCAAGGCCA | 1824 |
| | TGGCCTTGGCTTAGCGATGTTGAAAAGGTGATCCGTGAATTC TACAAACAGAGTCTTTTTGTACACGACTGAGGTGTTGAATGGA AAAGATTTTGGCACTCTAGGAGGAAATCTGCGTGAA | 1825 |

TABLE 20-continued

Factor VIII Mutations and Genome-Correcting Oligos

| Clinical Phenotype & Mutation | Correcting Oligos | SEQ ID NO: |
|---|---|---|
| | GTCGTGTACAAAAAGAC | 1826 |
| | GTCTTTTTGTACACGAC | 1827 |
| Haemophilia A Asp56Glu GATc-GAA | ATCTTTTCCATTCAACACCTCAGTCGTGTACAAAAAGACTCTG TTTGTAGAATTCACGGATCACCTTTTCAACATCGCTAAGCCAA GGCCACCCTGGATGGGTAATGAAAACAATGTTGAA | 1828 |
| | TTCAACATTGTTTTCATTACCCATCCAGGGTGGCCTTGGCTTA GCGATGTTGAAAAGGTGATCCGTGAATTCTACAAACAGAGTC TTTTTGTACACGACTGAGGTGTTGAATGGAAAAGAT | 1829 |
| | TTCACGGATCACCTTTT | 1830 |
| | AAAAGGTGATCCGTGAA | 1831 |
| Haemophilia A Gly73Val GGT-GTT | TTCTGGAGTACTATCCCCAAGTAACCTTTGGCGGACATCTCAT TCTTACAGGTCTGCTAGGTCCTACCATCCAGGCTGAGGTTTA TGATACAGTGGTCATTACACTTAAGAACATGGCTTC | 1832 |
| | GAAGCCATGTTCTTAAGTGTAATGACCACTGTATCATAAACCT CAGCCTGGATGGTAGGACCTAGCAGACCTGTAAGAATGAGAT GTCCGCCAAAGGTTACTTGGGGATAGTACTCCAGAA | 1833 |
| | TCTGCTAGGTCCTACCA | 1834 |
| | TGGTAGGACCTAGCAGA | 1835 |
| Haemophilia A Glu79Lys tGAG-AAG | CAAGTAACCTTTGGCGGACATCTCATTCTTACAGGTCTGCTAG GTCCTACCATCCAGGCTGAGGTTTATGATACAGTGGTCATTAC ACTTAAGAACATGGCTTCCCCATCCTGTCAGTCTTC | 1836 |
| | GAAGACTGACAGGATGGGAAGCCATGTTCTTAAGTGTAATGA CCACTGTATCATAAACCTCAGCCTGGATGGTAGGACCTAGCA GACCTGTAAGAATGAGATGTCCGCCAAAGGTTACTTG | 1837 |
| | TCCAGGCTGAGGTTTAT | 1838 |
| | ATAAACCTCAGCCTGGA | 1839 |
| Haemophilia A Val80Asp GTT-GAT | TAACCTTTGGCGGACATCTCATTCTTACAGGTCTGCTAGGTCC TACCATCCAGGCTGAGGTTTATGATACAGTGGTCATTACACTT AAGAACATGGCTTCCCCATCCTGTCAGTCTTCATGC | 1840 |
| | GCATGAAGACTGACAGGATGGGAAGCCATGTTCTTAAGTGTA ATGACCACTGTATCATAAACCTCAGCCTGGATGGTAGGACCT AGCAGACCTGTAAGAATGAGATGTCCGCCAAAGGTTA | 1841 |
| | GGCTGAGGTTTATGATA | 1842 |
| | TATCATAAACCTCAGCC | 1843 |
| Haemophilia A Asp82Val GAT-GTT | TTGGCGGACATCTCATTCTTACAGGTCTGCTAGGTCCTACCAT CCAGGCTGAGGTTTATGATACAGTGGTCATTACACTTAAGAAC ATGGCTTCCCATCCTGTCAGTCTTCATGCTGTTGG | 1844 |
| | CCAACAGCATGAAGACTGACAGGATGGGAAGCCATGTTCTTA AGTGTAATGACCACTGTATCATAAACCTCAGCCTGGATGGTA GGACCTAGCAGACCTGTAAGAATGAGATGTCCGCCAA | 1845 |
| | GGTTTATGATACAGTGG | 1846 |
| | CCACTGTATCATAAACC | 1847 |
| Haemophilia A Asp82Gly GAT-GGT | TTGGCGGACATCTCATTCTTACAGGTCTGCTAGGTCCTACCAT CCAGGCTGAGGTTTATGATACAGTGGTCATTACACTTAAGAAC ATGGCTTCCCATCCTGTCAGTCTTCATGCTGTTGG | 1848 |
| | CCAACAGCATGAAGACTGACAGGATGGGAAGCCATGTTCTTA AGTGTAATGACCACTGTATCATAAACCTCAGCCTGGATGGTA-GGACCTAGCAGACCTGTAAGAATGAGATGTCCGCCAA | 1849 |

TABLE 20-continued

Factor VIII Mutations and Genome-Correcting Oligos

| Clinical Phenotype & Mutation | Correcting Oligos | SEQ ID NO: |
|---|---|---|
| | GGTTTATGATACAGTGG | 1850 |
| | CCACTGTATCATAAACC | 1851 |
| Haemophilia A Val85Asp GTC-GAC | ATCTCATTCTTACAGGTCTGCTAGGTCCTACCATCCAGGCTGA GGTTTATGATACAGTGGTCATTACACTTAAGAACATGGCTTCC CATCCTGTCAGTCTTCATGCTGTTGGTGTATCCTA | 1852 |
| | TAGGATACACCAACAGCATGAAGACTGACAGGATGGGAAGCC ATGTTCTTAAGTGTAATGACCACTGTATCATAAACCTCAGCCT GGATGGTAGGACCTAGCAGACCTGTAAGAATGAGAT | 1853 |
| | TACAGTGGTCATTACAC | 1854 |
| | GTGTAATGACCACTGTA | 1855 |
| Haemophilia A Lys89Thr AAG-ACG | CAGGTCTGCTAGGTCCTACCATCCAGGCTGAGGTTTATGATA CAGTGGTCATTACACTTAAGAACATGGCTTCCCATCCTGTCA GTCTTCATGCTGTTGGTGTATCCTACTGGAAAGCTTC | 1856 |
| | GAAGCTTTCCAGTAGGATACACCAACAGCATGAAGACTGACA GGATGGGAAGCCATGTTCTTAAGTGTAATGACCACTGTATCAT AAACCTCAGCCTGGATGGTAGGACCTAGCAGACCTG | 1857 |
| | TACACTTAAGAACATGG | 1858 |
| | CCATGTTCTTAAGTGTA | 1859 |
| Haemophilia A Met91Val cATG-GTG | CTGCTAGGTCCTACCATCCAGGCTGAGGTTTATGATACAGTG GTCATTACACTTAAGAACATGGCTTCCCATCCTGTCAGTCTTC ATGCTGTTGGTGTATCCTACTGGAAAGCTTCTGAGG | 1860 |
| | CCTCAGAAGCTTTCCAGTAGGATACACCAACAGCATGAAGAC TGACAGGATGGGAAGCCATGTTCTTAAGTGTAATGACCACTG TATCATAAACCTCAGCCTGGATGGTAGGACCTAGCAG | 1861 |
| | TTAAGAACATGGCTTCC | 1862 |
| | GGAAGCCATGTTCTTAA | 1863 |
| Haemophilia A His94Arg CAT-CGT | CTACCATCCAGGCTGAGGTTTATGATACAGTGGTCATTACACT TAAGAACATGGCTTCCCATCCTGTCAGTCTTCATGCTGTTGGT GTATCCTACTGGAAAGCTTCTGAGGGTGAGTAAAA | 1864 |
| | TTTTACTCACCCTCAGAAGCTTTCCAGTAGGATACACCAACAG CATGAAGACTGACAGGATGGGAAGCCATGTTCTTAAGTGTAA TGACCACTGTATCATAAACCTCAGCCTGGATGGTAG | 1865 |
| | GGCTTCCCATCCTGTCA | 1866 |
| | TGACAGGATGGGAAGCC | 1867 |
| Haemophilia A His94Tyr cCAT-TAT | CCTACCATCCAGGCTGAGGTTTATGATACAGTGGTCATTACAC TTAAGAACATGGCTTCCCATCCTGTCAGTCTTCATGCTGTTGG TGTATCCTACTGGAAAGCTTCTGAGGGTGAGTAAAA | 1868 |
| | TTTACTCACCCTCAGAAGCTTTCCAGTAGGATACACCAACAGC ATGAAGACTGACAGGATGGGAAGCCATGTTCTTAAGTGTAAT GACCACTGTATCATAAACCTCAGCCTGGATGGTAGG | 1869 |
| | TGGCTTCCCATCCTGTC | 1870 |
| | GACAGGATGGGAAGCCA | 1871 |
| Haemophilia A Leu98Arg CTT-CGT | CTGAGGTTTATGATACAGTGGTCATTACACTTAAGAACATGGC TTCCCATCCTGTCAGTCTTCATGCTGTTGGTGTATCCTACTGG AAAGCTTCTGAGGGTGAGTAAAATACCCTCCTATT | 1872 |
| | AATAGGAGGGTATTTTACTCACCCTCAGAAGCTTTCCAGTAGG ATACACCAACAGCATGAAGACTGACAGGATGGGAAGCCATGT TCTTAAGTGTAATGACCACTGTATCATAAACCTCAG | 1873 |

TABLE 20-continued

Factor VIII Mutations and Genome-Correcting Oligos

| Clinical Phenotype & Mutation | Correcting Oligos | SEQ ID NO: |
|---|---|---|
| | TGTCAGTCTTCATGCTG | 1874 |
| | CAGCATGAAGACTGACA | 1875 |
| Haemophilia A Gly102Ser tGGT-AGT | GATACAGTGGTCATTACACTTAAGAACATGGCTTCCCATCCTG TCAGTCTTCATGCTGTTGGTGTATCCTACTGGAAAGCTTCTGA GGGTGAGTAAAATACCCTCCTATTGTCCTGTATT | 1876 |
| | AATGACAGGACAATAGGAGGGTATTTTACTCACCCTCAGAAG CTTTCCAGTAGGATACACCAACAGCATGAAGACTGACAGGAT GGGAAGCCATGTTCTTAAGTGTAATGACCACTGTATC | 1877 |
| | ATGCTGTTGGTGTATCC | 1878 |
| | GGATACACCAACAGCAT | 1879 |
| Haemophilia A Glu113Asp GAAt-GAC | CTTTGAGTGTACAGTGGATATAGAAAGGACAATTTTATTTCTTC CTGCTATAGGAGCTGAATATGATGATCAGACCAGTCAAAGGG AGAAAGAAGATGATAAAGTCTTCCCTGGTGGAAGC | 1880 |
| | GCTTCCACCAGGGAAGACTTTATCATCTTCTTTCTCCCTTTGA CTGGTCTGATCATCATATTCAGCTCCTATAGCAGGAAGAAATA AAATTGTCCTTTCTATATCCACTGTACACTCAAAG | 1881 |
| | GGAGCTGAATATGATGA | 1882 |
| | TCATCATATTCAGCTCC | 1883 |
| Haemophilia A Tyr114Cys TAT-TGT | TTGAGTGTACAGTGGATATAGAAAGGACAATTTTATTTCTTCCT GCTATAGGAGCTGAATATGATGATCAGACCAGTCAAAGGGAG AAAGAAGATGATAAAGTCTTCCCTGGTGGAAGCCA | 1884 |
| | TGGCTTCCACCAGGGAAGACTTTATCATCTTCTTTCTCCCTTT GACTGGTCTGATCATCATATTCAGCTCCTATAGCAGGAAGAAA TAAAATTGTCCTTTCTATATCCACTGTACACTCAA | 1885 |
| | AGCTGAATATGATGATC | 1886 |
| | GATCATCATATTCAGCT | 1887 |
| Haemophilia A Asp116Gly GAT-GGT | GTACAGTGGATATAGAAAGGACAATTTTATTTCTTCCTGCTATA GGAGCTGAATATGATGATCAGACCAGTCAAAGGGAGAAAGAA GATGATAAAGTCTTCCCTGGTGGAAGCCATACATA | 1888 |
| | TATGTATGGCTTCCACCAGGGAAGACTTTATCATCTTCTTTCT CCCTTTGACTGGTCTGATCATCATATTCAGCTCCTATAGCAGG AAGAAATAAAATTGTCCTTTCTATATCCACTGTAC | 1889 |
| | ATATGATGATCAGACCA | 1890 |
| | TGGTCTGATCATCATAT | 1891 |
| Haemophilia A Gln117Term tCAG-TAG | ACAGTGGATATAGAAAGGACAATTTTATTTCTTCCTGCTATAG GAGCTGAATATGATGATCAGACCAGTCAAAGGGAGAAAGAAG ATGATAAAGTCTTCCCTGGTGGAAGCCATACATATG | 1892 |
| | CATATGTATGGCTTCCACCAGGGAAGACTTTATCATCTTCTTT CTCCCTTTGACTGGTCTGATCATCATATTCAGCTCCTATAGCA GGAAGAAATAAAATTGTCCTTTCTATATCCACTGT | 1893 |
| | ATGATGATCAGACCAGT | 1894 |
| | ACTGGTCTGATCATCAT | 1895 |
| Haemophilia A Thr118Ile ACC-ATC | TGGATATAGAAAGGACAATTTTATTTCTTCCTGCTATAGGAGC TGAATATGATGATCAGACCAGTCAAAGGGAGAAAGAAGATGA TAAAGTCTTCCCTGGTGGAAGCCATACATATGTCTG | 1896 |
| | CAGACATATGTATGGCTTCCACCAGGGAAGACTTTATCATCTT CTTTCTCCCTTTGACTGGTCTGATCATCATATTCAGCTCCTAT AGCAGGAAGAAATAAAATTGTCCTTTCTATATCCA | 1897 |

TABLE 20-continued

Factor VIII Mutations and Genome-Correcting Oligos

| Clinical Phenotype & Mutation | Correcting Oligos | SEQ ID NO: |
|---|---|---|
| | TGATCAGACCAGTCAAA | 1898 |
| | TTTGACTGGTCTGATCA | 1899 |
| Haemophilia A Glu122Term gGAG-TAG | AGGACAATTTTATTTCTTCCTGCTATAGGAGCTGAATATGATG ATCAGACCAGTCAAAGGGAGAAAGAAGATGATAAAGTCTTCC CTGGTGGAAGCCATACATATGTCTGGCAGGTCCTGA | 1900 |
| | TCAGGACCTGCCAGACATATGTATGGCTTCCACCAGGGAAGA CTTTATCATCTTCTTTCTCCCTTTGACTGGTCTGATCATCATAT TCAGCTCCTATAGCAGGAAGAAATAAAATTGTCCT | 1901 |
| | GTCAAAGGGAGAAAGAA | 1902 |
| | TTCTTTCTCCCTTTGAC | 1903 |
| Haemophilia A Asp126His tGAT-CAT | TTTCTTCCTGCTATAGGAGCTGAATATGATGATCAGACCAGTC AAAGGGAGAAAGAAGATGATAAAGTCTTCCCTGGTGGAAGCC ATACATATGTCTGGCAGGTCCTGAAAGAGAATGGTC | 1904 |
| | GACCATTCTCTTTCAGGACCTGCCAGACATATGTATGGCTTCC ACCAGGGAAGACTTTATCATCTTCTTTCTCCCTTTGACTGGTC TGATCATCATATTCAGCTCCTATAGCAGGAAGAAA | 1905 |
| | AAGAAGATGATAAAGTC | 1906 |
| | GACTTTATCATCTTCTT | 1907 |
| Haemophilia A Gln139Term gCAG-TAG | AGTCAAAGGGAGAAAGAAGATGATAAAGTCTTCCCTGGTGGA AGCCATACATATGTCTGGCAGGTCCTGAAAGAGAATGGTCCA ATGGCCTCTGACCCACTGTGCCTTACCTACTCATATC | 1908 |
| | GATATGAGTAGGTAAGGCACAGTGGGTCAGAGGCCATTGGA CCATTCTCTTTCAGGACCTGCCAGACATATGTATGGCTTCCAC CAGGGAAGACTTTATCATCTTCTTTCTCCCTTTGACT | 1909 |
| | ATGTCTGGCAGGTCCTG | 1910 |
| | CAGGACCTGCCAGACAT | 1911 |
| Haemophilia A Val140Ala GTC-GCC | AAAGGGAGAAAGAAGATGATAAAGTCTTCCCTGGTGGAAGCC ATACATATGTCTGGCAGGTCCTGAAAGAGAATGGTCCAATGG CCTCTGACCCACTGTGCCTTACCTACTCATATCTTTC | 1912 |
| | GAAAGATATGAGTAGGTAAGGCACAGTGGGTCAGAGGCCATT GGACCATTCTCTTTCAGGACCTGCCAGACATATGTATGGCTT CCACCAGGGAAGACTTTATCATCTTCTTTCTCCCTTT | 1913 |
| | CTGGCAGGTCCTGAAAG | 1914 |
| | CTTTCAGGACCTGCCAG | 1915 |
| Haemophilia A Asn144Lys AATg-AAA | AGATGATAAAGTCTTCCCTGGTGGAAGCCATACATATGTCTG GCAGGTCCTGAAAGAGAATGGTCCAATGGCCTCTGACCCACT GTGCCTTACCTACTCATATCTTTCTCATGTGGACCTG | 1916 |
| | CAGGTCCACATGAGAAAGATATGAGTAGGTAAGGCACAGTGG GTCAGAGGCCATTGGACCATTCTCTTTCAGGACCTGCCAGAC ATATGTATGGCTTCCACCAGGGAAGACTTTATCATCT | 1917 |
| | AAAGAGAATGGTCCAAT | 1918 |
| | ATTGGACCATTCTCTTT | 1919 |
| Haemophilia AG Gly145Asp GGT-GAT | ATGATAAAGTCTTCCCTGGTGGAAGCCATACATATGTCTGGCA GGTCCTGAAAGAGAATGGTCCAATGGCCTCTGACCCACTGTG CCTTACCTACTCATATCTTTCTCATGTGGACCTGGT | 1920 |
| | ACCAGGTCCACATGAGAAAGATATGAGTAGGTAAGGCACAGT GGGTCAGAGGCCATTGGACCATTCTCTTTCAGGACCTGCCAG ACATATGTATGGCTTCCACCAGGGAAGACTTTATCAT | 1921 |

TABLE 20-continued

Factor VIII Mutations and Genome-Correcting Oligos

| Clinical Phenotype & Mutation | Correcting Oligos | SEQ ID NO: |
|---|---|---|
| | AGAGAATGGTCCAATGG | 1922 |
| | CCATTGGACCATTCTCT | 1923 |
| Haemophilia A Gly145Val GGT-GTT | ATGATAAAGTCTTCCCTGGTGGAAGCCATACATATGTCTGGCA GGTCCTGAAAGAGAATGGTCCAATGGCCTCTGACCCACTGTG CCTTACCTACTCATATCTTTCTCATGTGGACCTGGT | 1924 |
| | ACCAGGTCCACATGAGAAAGATATGAGTAGGTAAGGCACAGT GGGTCAGAGGCCATTGGACCATTCTCTTTCAGGACCTGCCAG ACATATGTATGGCTTCCACCAGGGAAGACTTTATCAT | 1925 |
| | AGAGAATGGTCCAATGG | 1926 |
| | CCATTGGACCATTCTCT | 1927 |
| Haemophilia A Pro146Ser tCCA-TCA | GATAAAGTCTTCCCTGGTGGAAGCCATACATATGTCTGGCAG GTCCTGAAAGAGAATGGTCCAATGGCCTCTGACCCACTGTGC CTTACCTACTCATATCTTTCTCATGTGGACCTGGTAA | 1928 |
| | TTACCAGGTCCACATGAGAAAGATATGAGTAGGTAAGGCACA GTGGGTCAGAGGCCATTGGACCATTCTCTTTCAGGACCTGCC AGACATATGTATGGCTTCCACCAGGGAAGACTTTATC | 1929 |
| | AGAATGGTCCAATGGCC | 1930 |
| | GGCCATTGGACCATTCT | 1931 |
| Haemophilia A Cys153Trp TGCc-TGG | CCATACATATGTCTGGCAGGTCCTGAAAGAGAATGGTCCAAT GGCCTCTGACCCACTGTGCCTTACCTACTCATATCTTTCTCAT GTGGACCTGGTAAAAGACTTGAATTCAGGCCTCATT | 1932 |
| | AATGAGGCCTGAATTCAAGTCTTTTACCAGGTCCACATGAGAA AGATATGAGTAGGTAAGGCACAGTGGGTCAGAGGCCATTGGA CCATTCTCTTTCAGGACCTGCCAGACATATGTATGG | 1933 |
| | CCACTGTGCCTTACCTA | 1934 |
| | TAGGTAAGGCACAGTGG | 1935 |
| Haemophilia A Tyr156Term TACt-TAA | TGTCTGGCAGGTCCTGAAAGAGAATGGTCCAATGGCCTCTGA CCCACTGTGCCTTACCTACTCATATCTTTCTCATGTGGACCTG GTAAAAGACTTGAATTCAGGCCTCATTGGAGCCCTA | 1936 |
| | TAGGGCTCCAATGAGGCCTGAATTCAAGTCTTTTACCAGGTC CACATGAGAAAGATATGAGTAGGTAAGGCACAGTGGGTCAGA GGCCATTGGACCATTCTCTTTCAGGACCTGCCAGACA | 1937 |
| | CTTACCTACTCATATCT | 1938 |
| | AGATATGAGTAGGTAAG | 1939 |
| Haemophilia A Ser157Pro cTCA-CCA | GTCTGGCAGGTCCTGAAAGAGAATGGTCCAATGGCCTCTGAC CCACTGTGCCTTACCTACTCATATCTTTCTCATGTGGACCTGG TAAAAGACTTGAATTCAGGCCTCATTGGAGCCCTAC | 1940 |
| | GTAGGGCTCCAATGAGGCCTGAATTCAAGTCTTTTACCAGGT CCACATGAGAAAGATATGAGTAGGTAAGGCACAGTGGGTCAG AGGCCATTGGACCATTCTCTTTCAGGACCTGCCAGAC | 1941 |
| | TTACCTACTCATATCTT | 1942 |
| | AAGATATGAGTAGGTAA | 1943 |
| Haemophilia A Ser160Pro tTCT-CCT | GTCCTGAAAGAGAATGGTCCAATGGCCTCTGACCCACTGTGC CTTACCTACTCATATCTTTCTCATGTGGACCTGGTAAAAGACT TGAATTCAGGCCTCATTGGAGCCCTACTAGTATGTA | 1944 |
| | TACATACTAGTAGGGCTCCAATGAGGCCTGAATTCAAGTCTTT TACCAGGTCCACATGAGAAAGATATGAGTAGGTAAGGCACAG TGGGTCAGAGGCCATTGGACCATTCTCTTTCAGGAC | 1945 |

TABLE 20-continued

Factor VIII Mutations and Genome-Correcting Oligos

| Clinical Phenotype & Mutation | Correcting Oligos | SEQ ID NO: |
|---|---|---|
| | CATATCTTTCTCATGTG | 1946 |
| | CACATGAGAAAGATATG | 1947 |
| Haemophilia A Val162Met tGTG-ATG | AAAGAGAATGGTCCAATGGCCTCTGACCCACTGTGCCTTACC TACTCATATCTTTCTCATGTGGACCTGGTAAAAGACTTGAATT CAGGCCTCATTGGAGCCCTACTAGTATGTAGAGAAG | 1948 |
| | CTTCTCTACATACTAGTAGGGCTCCAATGAGGCCTGAATTCAA GTCTTTTACCAGGTCCACATGAGAAAGATATGAGTAGGTAAG GCACAGTGGGTCAGAGGCCATTGGACCATTCTCTTT | 1949 |
| | TTTCTCATGTGGACCTG | 1950 |
| | CAGGTCCACATGAGAAA | 1951 |
| Haemophilia A Lys166Thr AAA-ACA | CAATGGCCTCTGACCCACTGTGCCTTACCTACTCATATCTTTC TCATGTGGACCTGGTAAAAGACTTGAATTCAGGCCTCATTGG AGCCCTACTAGTATGTAGAGAAGGTAAGTGTATGAA | 1952 |
| | TTCATACACTTACCTTCTCTACATACTAGTAGGGCTCCAATGA GGCCTGAATTCAAGTCTTTTACCAGGTCCACATGAGAAAGATA TGAGTAGGTAAGGCACAGTGGGTCAGAGGCCATTG | 1953 |
| | CCTGGTAAAAGACTTGA | 1954 |
| | TCAAGTCTTTTACCAGG | 1955 |
| Haemophilia A Ser170Leu TCA-TTA | ACCCACTGTGCCTTACCTACTCATATCTTTCTCATGTGGACCT GGTAAAAGACTTGAATTCAGGCCTCATTGGAGCCCTACTAGT ATGTAGAGAAGGTAAGTGTATGAAAGCGTAGGATTG | 1956 |
| | CAATCCTACGCTTTCATACACTTACCTTCTCTACATACTAGTAG GGCTCCAATGAGGCCTGAATTCAAGTCTTTTACCAGGTCCAC ATGAGAAAGATATGAGTAGGTAAGGCACAGTGGGT | 1957 |
| | CTTGAATTCAGGCCTCA | 1958 |
| | TGAGGCCTGAATTCAAG | 1959 |
| Haemophilia A Phe195Val aTTT-GTT | AATGTTCTCACTTCTTTTTCAGGGAGTCTGGCCAAGGAAAAGA CACAGACCTTGCACAAATTTATACTACTTTTTGCTGTATTTGAT GAAGGTTAGTGAGTCTTAATCTGAATTTTGGATT | 1960 |
| | AATCCAAAATTCAGATTAAGACTCACTAACCTTCATCAAATACA GCAAAAAGTAGTATAAATTTGTGCAAGGTCTGTGTCTTTTCCT TGGCCAGACTCCCTGAAAAGAAGTGAGAACATT | 1961 |
| | TGCACAAATTTATACTA | 1962 |
| | TAGTATAAATTTGTGCA | 1963 |
| Haemophilia A Leu198His CTT-CAT | CTTCTTTTTCAGGGAGTCTGGCCAAGGAAAAGACACAGACCT TGCACAAATTTATACTACTTTTTGCTGTATTTGATGAAGGTTAG TGAGTCTTAATCTGAATTTTGGATTCCTGAAAGAA | 1964 |
| | TTCTTTCAGGAATCCAAAATTCAGATTAAGACTCACTAACCTTC ATCAAATACAGCAAAAAGTAGTATAAATTTGTGCAAGGTCTGT GTCTTTTCCTTGGCCAGACTCCCTGAAAAGAAG | 1965 |
| | TATACTACTTTTTGCTG | 1966 |
| | CAGCAAAAAGTAGTATA | 1967 |
| Haemophilia A Ala200Asp GCT-GAT | TTTCAGGGAGTCTGGCCAAGGAAAAGACACAGACCTTGCACA AATTTATACTACTTTTTGCTGTATTTGATGAAGGTTAGTGAGTC TTAATCTGAATTTTGGATTCCTGAAAGAAATCCTC | 1968 |
| | GAGGATTTCTTTCAGGAATCCAAAATTCAGATTAAGACTCACT AACCTTCATCAAATACAGCAAAAAGTAGTATAAATTTGTGCAA GGTCTGTGTCTTTTCCTTGGCCAGACTCCCTGAAA | 1969 |

TABLE 20-continued

Factor VIII Mutations and Genome-Correcting Oligos

| Clinical Phenotype & Mutation | Correcting Oligos | SEQ ID NO: |
|---|---|---|
| | ACTTTTTGCTGTATTTG | 1970 |
| | CAAATACAGCAAAAAGT | 1971 |
| Haemophilia A Ala200Thr tGCT-ACT | TTTTCAGGGAGTCTGGCCAAGGAAAAGACACAGACCTTGCAC AAATTTATACTACTTTTTGCTGTATTTGATGAAGGTTAGTGAGT CTTAATCTGAATTTTGGATTCCTGAAAGAAATCCT | 1972 |
| | AGGATTTCTTTCAGGAATCCAAAATTCAGATTAAGACTCACTA ACCTTCATCAAATACAGCAAAAGTAGTATAAATTTGTGCAAG GTCTGTGTCTTTTCCTTGGCCAGACTCCCTGAAAA | 1973 |
| | TACTTTTTGCTGTATTT | 1974 |
| | AAATACAGCAAAAGTA | 1975 |
| Haemophilia A Val234Phe aGTC-TTC | AACTCCTTGATGCAGGATAGGGATGCTGCATCTGCTCGGGCC TGGCCTAAAATGCACACAGTCAATGGTTATGTAAACAGGTCTC TGCCAGGTATGTACACACCTGCTCAACAATCCTCAG | 1976 |
| | CTGAGGATTGTTGAGCAGGTGTGTACATACCTGGCAGAGACC TGTTTACATAACCATTGACTGTGTGCATTTTAGGCCAGGCCCG AGCAGATGCAGCATCCCTATCCTGCATCAAGGAGTT | 1977 |
| | TGCACACAGTCAATGGT | 1978 |
| | ACCATTGACTGTGTGCA | 1979 |
| Haemophilia A Gly247Glu GGA-GAA | ATTTCAGATTCTCTACTTCATAGCCATAGGTGTCTTATTCCTAC TTTACAGGTCTGATTGGATGCCACAGGAAATCAGTCTATTGGC ATGTGATTGGAATGGGCACCACTCCTGAAGTGCA | 1980 |
| | TGCACTTCAGGAGTGGTGCCCATTCCAATCACATGCCAATAG ACTGATTTCCTGTGGCATCCAATCAGACCTGTAAAGTAGGAAT AAGACACCTATGGCTATGAAGTAGAGAATCTGAAAT | 1981 |
| | TCTGATTGGATGCCACA | 1982 |
| | TGTGGCATCCAATCAGA | 1983 |
| Haemophilia A Trp255Cys TGGc-TGT | ATAGGTGTCTTATTCCTACTTTACAGGTCTGATTGGATGCCAC AGGAAATCAGTCTATTGGCATGTGATTGGAATGGGCACCACT CCTGAAGTGCACTCAATATTCCTCGAAGGTCACACA | 1984 |
| | TGTGTGACCTTCGAGGAATATTGAGTGCACTTCAGGAGTGGT GCCCATTCCAATCACATGCCAATAGACTGATTTCCTGTGGCAT CCAATCAGACCTGTAAAGTAGGAATAAGACACCTAT | 1985 |
| | GTCTATTGGCATGTGAT | 1986 |
| | ATCACATGCCAATAGAC | 1987 |
| Haemophilia A Trp255Term TGGc-TGA | ATAGGTGTCTTATTCCTACTTTACAGGTCTGATTGGATGCCAC AGGAAATCAGTCTATTGGCATGTGATTGGAATGGGCACCACT CCTGAAGTGCACTCAATATTCCTCGAAGGTCACACA | 1988 |
| | TGTGTGACCTTCGAGGAATATTGAGTGCACTTCAGGAGTGGT GCCCATTCCAATCACATGCCAATAGACTGATTTCCTGTGGCAT CCAATCAGACCTGTAAAGTAGGAATAAGACACCTAT | 1989 |
| | GTCTATTGGCATGTGAT | 1990 |
| | ATCACATGCCAATAGAC | 1991 |
| Haemophilia A His256Leu CAT-CTT | AGGTGTCTTATTCCTACTTTACAGGTCTGATTGGATGCCACAG GAAATCAGTCTATTGGCATGTGATTGGAATGGGCACCACTCC TGAAGTGCACTCAATATTCCTCGAAGGTCACACATT | 1992 |
| | AATGTGTGACCTTCGAGGAATATTGAGTGCACTTCAGGAGTG GTGCCCATTCCAATCACATGCCAATAGACTGATTTCCTGTGG CATCCAATCAGACCTGTAAAGTAGGAATAAGACACCT | 1993 |

TABLE 20-continued

Factor VIII Mutations and Genome-Correcting Oligos

| Clinical Phenotype & Mutation | Correcting Oligos | SEQ ID NO: |
|---|---|---|
| | CTATTGGCATGTGATTG | 1994 |
| | CAATCACATGCCAATAG | 1995 |
| Haemophilia A Gly259Arg tGGA-AGA | TATTCCTACTTTACAGGTCTGATTGGATGCCACAGGAAATCAG TCTATTGGCATGTGATTGGAATGGGCACCACTCCTGAAGTGC ACTCAATATTCCTCGAAGGTCACACATTTCTTGTGA | 1996 |
| | TCACAAGAAATGTGTGACCTTCGAGGAATATTGAGTGCACTTC AGGAGTGGTGCCCATTCCAATCACATGCCAATAGACTGATTT CCTGTGGCATCCAATCAGACCTGTAAAGTAGGAATA | 1997 |
| | ATGTGATTGGAATGGGC | 1998 |
| | GCCCATTCCAATCACAT | 1999 |
| Haemophilia A Val266Gly GTG-GGG | TTGGATGCCACAGGAAATCAGTCTATTGGCATGTGATTGGAAT GGGCACCACTCCTGAAGTGCACTCAATATTCCTCGAAGGTCA CACATTTCTTGTGAGGAACCATCGCCAGGCGTCCTT | 2000 |
| | AAGGACGCCTGGCGATGGTTCCTCACAAGAAATGTGTGACCT TCGAGGAATATTGAGTGCACTTCAGGAGTGGTGCCCATTCCA ATCACATGCCAATAGACTGATTTCCTGTGGCATCCAA | 2001 |
| | TCCTGAAGTGCACTCAA | 2002 |
| | TTGAGTGCACTTCAGGA | 2003 |
| Haemophilia A Glu272Gly GAA-GGA | CAGTCTATTGGCATGTGATTGGAATGGGCACCACTCCTGAAG TGCACTCAATATTCCTCGAAGGTCACACATTTCTTGTGAGGAA CCATCGCCAGGCGTCCTTGGAAATCTCGCCAATAAC | 2004 |
| | GTTATTGGCGAGATTTCCAAGGACGCCTGGCGATGGTTCCTC ACAAGAAATGTGTGACCTTCGAGGAATATTGAGTGCACTTCAG GAGTGGTGCCCATTCCAATCACATGCCAATAGACTG | 2005 |
| | ATTCCTCGAAGGTCACA | 2006 |
| | TGTGACCTTCGAGGAAT | 2007 |
| Haemophilia A Glu272Lys cGAA-AAA | TCAGTCTATTGGCATGTGATTGGAATGGGCACCACTCCTGAA GTGCACTCAATATTCCTCGAAGGTCACACATTTCTTGTGAGGA ACCATCGCCAGGCGTCCTTGGAAATCTCGCCAATAA | 2008 |
| | TTATTGGCGAGATTTCCAAGGACGCCTGGCGATGGTTCCTCA CAAGAAATGTGTGACCTTCGAGGAATATTGAGTGCACTTCAG GAGTGGTGCCCATTCCAATCACATGCCAATAGACTGA | 2009 |
| | TATTCCTCGAAGGTCAC | 2010 |
| | GTGACCTTCGAGGAATA | 2011 |
| Haemophilia A Thr275Ile ACA-ATA | GGCATGTGATTGGAATGGGCACCACTCCTGAAGTGCACTCAA TATTCCTCGAAGGTCACACATTTCTTGTGAGGAACCATCGCCA GGCGTCCTTGGAAATCTCGCCAATAACTTTCCTTAC | 2012 |
| | GTAAGGAAAGTTATTGGCGAGATTTCCAAGGACGCCTGGCGA TGGTTCCTCACAAGAAATGTGTGACCTTCGAGGAATATTGAGT GCACTTCAGGAGTGGTGCCCATTCCAATCACATGCC | 2013 |
| | AGGTCACACATTTCTTG | 2014 |
| | CAAGAAATGTGTGACCT | 2015 |
| Haemophilia A Val278Ala GTG-GCG | TTGGAATGGGCACCACTCCTGAAGTGCACTCAATATTCCTCG AAGGTCACACATTTCTTGTGAGGAACCATCGCCAGGCGTCCT TGGAAATCTCGCCAATAACTTTCCTTACTGCTCAAAC | 2016 |
| | GTTTGAGCAGTAAGGAAAGTTATTGGCGAGATTTCCAAGGAC GCCTGGCGATGGTTCCTCACAAGAAATGTGTGACCTTCGAGG AATATTGAGTGCACTTCAGGAGTGGTGCCCATTCCAA | 2017 |

TABLE 20-continued

Factor VIII Mutations and Genome-Correcting Oligos

| Clinical Phenotype & Mutation | Correcting Oligos | SEQ ID NO: |
|---|---|---|
| | ATTTCTTGTGAGGAACC | 2018 |
| | GGTTCCTCACAAGAAAT | 2019 |
| Haemophilia A Asn280Ile AAC-ATC | TGGGCACCACTCCTGAAGTGCACTCAATATTCCTCGAAGGTC ACACATTTCTTGTGAGGAACCATCGCCAGGCGTCCTTGGAAA TCTCGCCAATAACTTTCCTTACTGCTCAAACACTCTT | 2020 |
| | AAGAGTGTTTGAGCAGTAAGGAAAGTTATTGGCGAGATTTCCA AGGACGCCTGGCGATGGTTCCTCACAAGAAATGTGTGACCTT CGAGGAATATTGAGTGCACTTCAGGAGTGGTGCCCA | 2021 |
| | TGTGAGGAACCATCGCC | 2022 |
| | GGCGATGGTTCCTCACA | 2023 |
| Haemophilia A Arg282Cys tCGC-TGC | ACCACTCCTGAAGTGCACTCAATATTCCTCGAAGGTCACACAT TTCTTGTGAGGAACCATCGCCAGGCGTCCTTGGAAATCTCGC CAATAACTTTCCTTACTGCTCAAACACTCTTGATGG | 2024 |
| | CCATCAAGAGTGTTTGAGCAGTAAGGAAAGTTATTGGCGAGA TTTCCAAGGACGCCTGGCGATGGTTCCTCACAAGAAATGTGT GACCTTCGAGGAATATTGAGTGCACTTCAGGAGTGGT | 2025 |
| | GGAACCATCGCCAGGCG | 2026 |
| | CGCCTGGCGATGGTTCC | 2027 |
| Haemophilia A Arg282His CGC-CAC | CCACTCCTGAAGTGCACTCAATATTCCTCGAAGGTCACACATT TCTTGTGAGGAACCATCGCCAGGCGTCCTTGGAAATCTCGCC AATAACTTTCCTTACTGCTCAAACACTCTTGATGGA | 2028 |
| | TCCATCAAGAGTGTTTGAGCAGTAAGGAAAGTTATTGGCGAG ATTTCCAAGGACGCCTGGCGATGGTTCCTCACAAGAAATGTG TGACCTTCGAGGAATATTGAGTGCACTTCAGGAGTGG | 2029 |
| | GAACCATCGCCAGGCGT | 2030 |
| | ACGCCTGGCGATGGTTC | 2031 |
| Haemophilia A Arg282Leu CGC-CTC | CCACTCCTGAAGTGCACTCAATATTCCTCGAAGGTCACACATT TCTTGTGAGGAACCATCGCCAGGCGTCCTTGGAAATCTCGCC AATAACTTTCCTTACTGCTCAAACACTCTTGATGGA | 2032 |
| | TCCATCAAGAGTGTTTGAGCAGTAAGGAAAGTTATTGGCGAG ATTTCCAAGGACGCCTGGCGATGGTTCCTCACAAGAAATGTG TGACCTTCGAGGAATATTGAGTGCACTTCAGGAGTGG | 2033 |
| | GAACCATCGCCAGGCGT | 2034 |
| | ACGCCTGGCGATGGTTC | 2035 |
| Haemophilia A Ala284Glu GCG-GAG | CTGAAGTGCACTCAATATTCCTCGAAGGTCACACATTTCTTGT GAGGAACCATCGCCAGGCGTCCTTGGAAATCTCGCCAATAAC TTTCCTTACTGCTCAAACACTCTTGATGGACCTTGG | 2036 |
| | CCAAGGTCCATCAAGAGTGTTTGAGCAGTAAGGAAAGTTATT GGCGAGATTTCCAAGGACGCCTGGCGATGGTTCCTCACAAG AAATGTGTGACCTTCGAGGAATATTGAGTGCACTTCAG | 2037 |
| | TCGCCAGGCGTCCTTGG | 2038 |
| | CCAAGGACGCCTGGCGA | 2039 |
| Haemophilia A Ala284Pro gGCG-CCG | CCTGAAGTGCACTCAATATTCCTCGAAGGTCACACATTTCTTG TGAGGAACCATCGCCAGGGCGTCCTTGGAAATCTCGCCAATAA CTTTCCTTACTGCTCAAACACTCTTGATGGACCTTG | 2040 |
| | CAAGGTCCATCAAGAGTGTTTGAGCAGTAAGGAAAGTTATTG GCGAGATTTCCAAGGACGCCTGGCGATGGTTCCTCACAAGAA ATGTGTGACCTTCGAGGAATATTGAGTGCACTTCAGG | 2041 |

TABLE 20-continued

Factor VIII Mutations and Genome-Correcting Oligos

| Clinical Phenotype & Mutation | Correcting Oligos | SEQ ID NO: |
|---|---|---|
| | ATCGCCAGGCGTCCTTG | 2042 |
| | CAAGGACGCCTGGCGAT | 2043 |
| Haemophilia A Ser289Leu TCG-TTG | TATTCCTCGAAGGTCACACATTTCTTGTGAGGAACCATCGCCA GGCGTCCTTGGAAATCTCGCCAATAACTTTCCTTACTGCTCAA ACACTCTTGATGGACCTTGGACAGTTTCTACTGTT | 2044 |
| | AACAGTAGAAACTGTCCAAGGTCCATCAAGAGTGTTTGAGCA GTAAGGAAAGTTATTGGCGAGATTTCCAAGGACGCCTGGCGA TGGTTCCTCACAAGAAATGTGTGACCTTCGAGGAATA | 2045 |
| | GGAAATCTCGCCAATAA | 2046 |
| | TTATTGGCGAGATTTCC | 2047 |
| Haemophilia A Phe293Ser TTC-TCC | GTCACACATTTCTTGTGAGGAACCATCGCCAGGCGTCCTTGG AAATCTCGCCAATAACTTTTCCTTACTGCTCAAACACTCTTGAT GGACCTTGGACAGTTTCTACTGTTTTGTCATATCTC | 2048 |
| | GAGATATGACAAAACAGTAGAAACTGTCCAAGGTCCATCAAG AGTGTTTGAGCAGTAAGGAAAGTTATTGGCGAGATTTCCAAG GACGCCTGGCGATGGTTCCTCACAAGAAATGTGTGAC | 2049 |
| | AATAACTTTTCCTTACTG | 2050 |
| | CAGTAAGGAAAGTTATT | 2051 |
| Haemophilia A Thr295Ala tACT-GCT | ACATTTCTTGTGAGGAACCATCGCCAGGCGTCCTTGGAAATC TCGCCAATAACTTTCCTTACTGCTCAAACACTCTTGATGGACC TTGGACAGTTTCTACTGTTTTGTCATATCTCTTCCC | 2052 |
| | GGGAAGAGATATGACAAAACAGTAGAAACTGTCCAAGGTCCA TCAAGAGTGTTTGAGCAGTAAGGAAAGTTATTGGCGAGATTTC CAAGGACGCCTGGCGATGGTTCCTCACAAGAAATGT | 2053 |
| | CTTTCCTTACTGCTCAA | 2054 |
| | TTGAGCAGTAAGGAAAG | 2055 |
| Haemophilia A Thr295Ile ACT-ATT | CATTTCTTGTGAGGAACCATCGCCAGGCGTCCTTGGAAATCT CGCCAATAACTTTCCTTACTGCTCAAACACTCTTGATGGACCT TGGACAGTTTCTACTGTTTTGTCATATCTCTTCCCA | 2056 |
| | TGGGAAGAGATATGACAAAACAGTAGAAACTGTCCAAGGTCC ATCAAGAGTGTTTGAGCAGTAAGGAAAGTTATTGGCGAGATTT CCAAGGACGCCTGGCGATGGTTCCTCACAAGAAATG | 2057 |
| | TTTCCTTACTGCTCAAA | 2058 |
| | TTTGAGCAGTAAGGAAA | 2059 |
| Haemophilia A Ala296Val GCT-GTT | TTCTTGTGAGGAACCATCGCCAGGCGTCCTTGGAAATCTCGC CAATAACTTTCCTTACTGCTCAAACACTCTTGATGGACCTTGG ACAGTTTCTACTGTTTTGTCATATCTCTTCCCACCA | 2060 |
| | TGGTGGGAAGAGATATGACAAAACAGTAGAAACTGTCCAAGG TCCATCAAGAGTGTTTGAGCAGTAAGGAAAGTTATTGGCGAG ATTTCCAAGGACGCCTGGCGATGGTTCCTCACAAGAA | 2061 |
| | CCTTACTGCTCAAACAC | 2062 |
| | GTGTTTGAGCAGTAAGG | 2063 |
| Haemophilia A Leu308Pro CTG-CCG | TCTCGCCAATAACTTTCCTTACTGCTCAAACACTCTTGATGGA CCTTGGACAGTTTCTACTGTTTTGTCATATCTCTTCCCACCAA CATGGTAATATCTTGGATCTTTAAAATGAATATTA | 2064 |
| | TAATATTCATTTTAAAGATCCAAGATATTACCATGTTGGTGGGA AGAGATATGACAAAACAGTAGAAACTGTCCAAGGTCCATCAA GAGTGTTTGAGCAGTAAGGAAAGTTATTGGCGAGA | 2065 |

TABLE 20-continued

Factor VIII Mutations and Genome-Correcting Oligos

| Clinical Phenotype & Mutation | Correcting Oligos | SEQ ID NO: |
|---|---|---|
| | GTTTCTACTGTTTTGTC | 2066 |
| | GACAAAACAGTAGAAAC | 2067 |
| Haemophilia A Glu321Lys gGAA-AAA | ACAGCCTAATATAGCAAGACACTCTGACATTGTTTGGTTTGTC TGACTCCAGATGGCATGGAAGCTTATGTCAAAGTAGACAGCT GTCCAGAGGAACCCCAACTACGAATGAAAAATAATG | 2068 |
| | CATTATTTTTCATTCGTAGTTGGGGTTCCTCTGGACAGCTGTC TACTTTGACATAAGCTTCCATGCCATCTGGAGTCAGACAAACC AAACAATGTCAGAGTGTCTTGCTATATTAGGCTGT | 2069 |
| | ATGGCATGGAAGCTTAT | 2070 |
| | ATAAGCTTCCATGCCAT | 2071 |
| Haemophilia A Tyr323Term TATg-TAA | ATATAGCAAGACACTCTGACATTGTTTGGTTTGTCTGACTCCA GATGGCATGGAAGCTTATGTCAAAGTAGACAGCTGTCCAGAG GAACCCCAACTACGAATGAAAAATAATGAAGAAGC | 2072 |
| | CGCTTCTTCATTATTTTTCATTCGTAGTTGGGGTTCCTCTGGA CAGCTGTCTACTTTGACATAAGCTTCCATGCCATCTGGAGTCA GACAAACCAAACAATGTCAGAGTGTCTTGCTATAT | 2073 |
| | GAAGCTTATGTCAAAGT | 2074 |
| | ACTTTGACATAAGCTTC | 2075 |
| Haemophilia A Val326Leu aGTA-CTA | AAGACACTCTGACATTGTTTGGTTTGTCTGACTCCAGATGGCA TGGAAGCTTATGTCAAAGTAGACAGCTGTCCAGAGGAACCCC AACTACGAATGAAAAATAATGAAGAAGCGGAAGACT | 2076 |
| | AGTCTTCCGCTTCTTCATTATTTTTCATTCGTAGTTGGGGTTC CTCTGGACAGCTGTCTACTTTGACATAAGCTTCCATGCCATCT GGAGTCAGACAAACCAAACAATGTCAGAGTGTCTT | 2077 |
| | ATGTCAAAGTAGACAGC | 2078 |
| | GCTGTCTACTTTGACAT | 2079 |
| Haemophilia A Cys329Arg cTGT-CGT | TGACATTGTTTGGTTTGTCTGACTCCAGATGGCATGGAAGCTT ATGTCAAAGTAGACAGCTGTCCAGAGGAACCCCAACTACGAA TGAAAAATAATGAAGAAGCGGAAGACTATGATGATG | 2080 |
| | CATCATCATAGTCTTCCGCTTCTTCATTATTTTTCATTCGTAGT TGGGGTTCCTCTGGACAGCTGTCTACTTTGACATAAGCTTCC ATGCCATCTGGAGTCAGACAAACCAAACAATGTCA | 2081 |
| | TAGACAGCTGTCCAGAG | 2082 |
| | CTCTGGACAGCTGTCTA | 2083 |
| Haemophilia A Cys329Tyr TGT-TAT | GACATTGTTTGGTTTGTCTGACTCCAGATGGCATGGAAGCTTA TGTCAAAGTAGACAGCTGTCCAGAGGAACCCCAACTACGAAT GAAAAATAATGAAGAAGCGGAAGACTATGATGATGA | 2084 |
| | TCATCATCATAGTCTTCCGCTTCTTCATTATTTTTCATTCGTAG TTGGGGTTCCTCTGGACAGCTGTCTACTTTGACATAAGCTTCC ATGCCATCTGGAGTCAGACAAACCAAACAATGTC | 2085 |
| | AGACAGCTGTCCAGAGG | 2086 |
| | CCTCTGGACAGCTGTCT | 2087 |
| Haemophilia A Arg336Term aCGA-TGA | ACTCCAGATGGCATGGAAGCTTATGTCAAAGTAGACAGCTGT CCAGAGGAACCCCAACTACGAATGAAAAATAATGAAGAAGCG GAAGACTATGATGATGATCTTACTGATTCTGAAATGG | 2088 |
| | CCATTTCAGAATCAGTAAGATCATCATCATAGTCTTCCGCTTC TTCATTATTTTTCATTCGTAGTTGGGGTTCCTCTGGACAGCTG TCTACTTTGACATAAGCTTCCATGCCATCTGGAGT | 2089 |

TABLE 20-continued

Factor VIII Mutations and Genome-Correcting Oligos

| Clinical Phenotype & Mutation | Correcting Oligos | SEQ ID NO: |
|---|---|---|
| | CCCAACTACGAATGAAA | 2090 |
| | TTTCATTCGTAGTTGGG | 2091 |
| Haemophilia A Arg372Cys tCGC-TGC | GATTCTGAAATGGATGTGGTCAGGTTTGATGATGACAACTCTC CTTCCTTTATCCAAATTCGCTCAGTTGCCAAGAAGCATCCTAA AACTTGGGTACATTACATTGCTGCTGAAGAGGAGG | 2092 |
| | CCTCCTCTTCAGCAGCAATGTCAATGTACCCAAGTTTTAGGATG CTTCTTGGCAACTGAGCGAATTTGGATAAAGGAAGGAGAGTT GTCATCATCAAACCTGACCACATCCATTTCAGAATC | 2093 |
| | TCCAAATTCGCTCAGTT | 2094 |
| | AACTGAGCGAATTTGGA | 2095 |
| Haemophilia A Arg372His CGC-CAC | ATTCTGAAATGGATGTGGTCAGGTTTGATGATGACAACTCTCC TTCCTTTATCCAAATTCGCTCAGTTGCCAAGAAGCATCCTAAA ACTTGGGTACATTACATTGCTGCTGAAGAGGAGGA | 2096 |
| | TCCTCCTCTTCAGCAGCAATGTAATGTACCCAAGTTTTAGGAT GCTTCTTGGCAACTGAGCGAATTTGGATAAAGGAAGGAGAGT TGTCATCATCAAACCTGACCACATCCATTTCAGAAT | 2097 |
| | CCAAATTCGCTCAGTTG | 2098 |
| | CAACTGAGCGAATTTGG | 2099 |
| Haemophilia A Ser373Leu TCA-TTA | CTGAAATGGATGTGGTCAGGTTTGATGATGACAACTCTCCTTC CTTTATCCAAATTCGCTCAGTTGCCAAGAAGCATCCTAAAACT TGGGTACATTACATTGCTGCTGAAGAGGAGGACTG | 2100 |
| | CAGTCCTCCTCTTCAGCAGCAATGTAATGTACCCAAGTTTTAG GATGCTTCTTGGCAACTGAGCGAATTTGGATAAAGGAAGGAG AGTTGTCATCATCAAACCTGACCACATCCATTTCAG | 2101 |
| | AATTCGCTCAGTTGCCA | 2102 |
| | TGGCAACTGAGCGAATT | 2103 |
| Haemophilia A Ser373Pro cTCA-CCA | TCTGAAATGGATGTGGTCAGGTTTGATGATGACAACTCTCCTT CCTTTATCCAAATTCGCTCAGTTGCCAAGAAGCATCCTAAAAC TTGGGTACATTACATTGCTGCTGAAGAGGAGGACT | 2104 |
| | AGTCCTCCTCTTCAGCAGCAATGTAATGTACCCAAGTTTTAGG ATGCTTCTTGGCAACTGAGCGAATTTGGATAAAGGAAGGAGA GTTGTCATCATCAAACCTGACCACATCCATTTCAGA | 2105 |
| | AAATTCGCTCAGTTGCC | 2106 |
| | GGCAACTGAGCGAATTT | 2107 |
| Haemophilia A Ser373Term TCA-TAA | CTGAAATGGATGTGGTCAGGTTTGATGATGACAACTCTCCTTC CTTTATCCAAATTCGCTCAGTTGCCAAGAAGCATCCTAAAACT TGGGTACATTACATTGCTGCTGAAGAGGAGGACTG | 2108 |
| | CAGTCCTCCTCTTCAGCAGCAATGTAATGTACCCAAGTTTTAG GATGCTTCTTGGCAACTGAGCGAATTTGGATAAAGGAAGGAG AGTTGTCATCATCAAACCTGACCACATCCATTTCAG | 2109 |
| | ATTCGCTCAGTTGCCA | 2110 |
| | TGGCAACTGAGCGAATT | 2111 |
| Haemophilia A Ile386Phe cATT-TTT | CCTTCCTTTATCCAAATTCGCTCAGTTGCCAAGAAGCATCCTA AAACTTGGGTACATTACATTGCTGCTGAAGAGGAGGACTGGG ACTATGCTCCCTTAGTCCTCGCCCCCGATGACAGGT | 2112 |
| | ACCTGTCATCGGGGGCGAGGACTAAGGGAGCATAGTCCCAG TCCTCCTCTTCAGCAGCAATGTAATGTACCCAAGTTTTAGGAT GCTTCTTGGCAACTGAGCGAATTTGGATAAAGGAAGG | 2113 |

TABLE 20-continued

Factor VIII Mutations and Genome-Correcting Oligos

| Clinical Phenotype & Mutation | Correcting Oligos | SEQ ID NO: |
|---|---|---|
| | TACATTACATTGCTGCT | 2114 |
| | AGCAGCAATGTAATGTA | 2115 |
| Haemophilia A Ile386Ser ATT-AGT | CTTCCTTTATCCAAATTCGCTCAGTTGCCAAGAAGCATCCTAA AACTTGGGTACATTACATTGCTGCTGAAGAGGAGGACTGGGA CTATGCTCCCTTAGTCCTCGCCCCCGATGACAGGTA | 2116 |
| | TACCTGTCATCGGGGGCGAGGACTAAGGGAGCATAGTCCCA GTCCTCCTCTTCAGCAGCAIATGTAATGTACCCAAGTTTTAGGA TGCTTCTTGGCAACTGAGCGAATTTGGATAAAGGAAG | 2117 |
| | ACATTACATTGCTGCTG | 2118 |
| | CAGCAGCAATGTAATGT | 2119 |
| Haemophilia A Glu390Gly GAG-GGG | AAATTCGCTCAGTTGCCAAGAAGCATCCTAAAACTTGGGTACA TTACATTGCTGCTGAAGAGGAGGACTGGGACTATGCTCCCTT AGTCCTCGCCCCCGATGACAGGTAAGCACTTTTTGA | 2120 |
| | TCAAAAAGTGCTTACCTGTCATCGGGGGCGAGGACTAAGGGA GCATAGTCCCAGTCCTCCTCTTCAGCAGCAATGTAATGTACC CAAGTTTTAGGATGCTTCTTGGCAACTGAGCGAATTT | 2121 |
| | TGCTGAAGAGGAGGACT | 2122 |
| | AGTCCTCCTCTTCAGCA | 2123 |
| Haemophilia A Trp393Gly cTGG-GGG | TCAGTTGCCAAGAAGCATCCTAAAACTTGGGTACATTACATTG CTGCTGAAGAGGAGGACTGGGACTATGCTCCCTTAGTCCTCG CCCCCGATGACAGGTAAGCACTTTTTGACTATTGGT | 2124 |
| | ACCAATAGTCAAAAAGTGCTTACCTGTCATCGGGGCGAGGA CTAAGGGAGCATAGTCCCAGTCCTCCTCTTCAGCAGCAATGT AATGTACCCAAGTTTTAGGATGCTTCTTGGCAACTGA | 2125 |
| | AGGAGGACTGGGACTAT | 2126 |
| | ATAGTCCCAGTCCTCCT | 2127 |
| Haemophilia A Lys408Ile AAA-ATA | GCCTACCTAGAATTTTTCTTCCCAACCTCTCATCTTTTTTTCTC TTATACAGAAGTTATAAAGTCAATATTTGAACAATGGCCCTC AGCGGATTGGTAGGAAGTACAAAAAAGTCCGATT | 2128 |
| | AATCGGACTTTTTTGTACTTCCTACCAATCCGCTGAGGGCCAT TGTTCAAATATTGACTTTTATAACTTCTGTATAAGAGAAAAAAA GATGAGAGGTTGGGAAGAAAAATTCTAGGTAGGC | 2129 |
| | AAGTTATAAAAGTCAAT | 2130 |
| | ATTGACTTTTATAACTT | 2131 |
| Haemophilia A Leu412Phe TTGa-TTT | TTTTCTTCCCAACCTCTCATCTTTTTTCTCTTATACAGAAGTT ATAAAAGTCAATATTTGAACAATGGCCCTCAGCGGATTGGTAG GAAGTACAAAAAAGTCCGATTTATGGCATACACA | 2132 |
| | TGTGTATGCCATAAATCGGACTTTTTTGTACTTCCTACCAATC CGCTGAGGGCCATTGTTCAAATATTGACTTTTATAACTTCTGT ATAAGAGAAAAAAAGATGAGAGGTTGGGAAGAAAA | 2133 |
| | CAATATTTGAACAATGG | 2134 |
| | CCATTGTTCAAATATTG | 2135 |
| Haemophilia A Arg418Trp gCGG-TGG | TCATCTTTTTTTCTCTTATACAGAAGTTATAAAAGTCAATATTTG AACAATGGCCCTCAGCGGATTGGTAGGAAGTACAAAAAAGTC CGATTTATGGCATACACAGATGAAACCTTTAAGA | 2136 |
| | TCTTAAAGGTTTCATCTGTGTATGCCATAAATCGGACTTTTTTG TACTTCCTACCAATCCGCTGAGGGCCATTGTTCAAATATTGAC TTTATAACTTCTGTATAAGAGAAAAAAAGATGA | 2137 |

TABLE 20-continued

Factor VIII Mutations and Genome-Correcting Oligos

| Clinical Phenotype & Mutation | Correcting Oligos | SEQ ID NO: |
|---|---|---|
| | GCCCTCAGCGGATTGGT | 2138 |
| | ACCAATCCGCTGAGGGC | 2139 |
| Haemophilia A Gly420Val GGT-GTT | TTTTTCTCTTATACAGAAGTTATAAAAGTCAATATTTGAACAAT GGCCCTCAGCGGATTGGTAGGAAGTACAAAAAAGTCCGATTT ATGGCATACACAGATGAAACCTTTAAGACTCGTGA | 2140 |
| | TCACGAGTCTTAAAGGTTTCATCTGTGTATGCCATAAATCGGA CTTTTTTGTACTTCCTACCAATCCGCTGAGGGCCATTGTTCAA ATATTGGACTTTTATAACTTCTGTATAAGAGAAAAA | 2141 |
| | GCGGATTGGTAGGAAGT | 2142 |
| | ACTTCCTACCAATCCGC | 2143 |
| Haemophilia A Lys425Arg AAA-AGA | GAAGTTATAAAAGTCAATATTTGAACAATGGCCCTCAGCGGAT TGGTAGGAAGTACAAAAAGTCCGATTTATGGCATACACAGAT GAAACCTTTAAGACTCGTGAAGCTATTCAGCATGA | 2144 |
| | TCATGCTGAATAGCTTCACGAGTCTTAAAGGTTTCATCTGTGT ATGCCATAAATCGGACTTTTTTGTACTTCCTACCAATCCGCTG AGGGCCATTGTTCAAATATTGACTTTTATAACTTC | 2145 |
| | GTACAAAAAGTCCGAT | 2146 |
| | ATCGGACTTTTTTGTAC | 2147 |
| Haemophilia A Arg427Term cCGA-TGA | TATAAAAGTCAATATTTGAACAATGGCCCTCAGCGGATTGGTA GGAAGTACAAAAAAGTCCGATTTATGGCATACACAGATGAAAC CTTTAAGACTCGTGAAGCTATTCAGCATGAATCAG | 2148 |
| | CTGATTCATGCTGAATAGCTTCACGAGTCTTAAAGGTTTCATC TGTGTATGCCATAAATCGGACTTTTTGTACTTCCTACCAATC CGCTGAGGGCCATTGTTCAAATATTGACTTTTATA | 2149 |
| | AAAAAGTCCGATTTATG | 2150 |
| | CATAAATCGGACTTTTT | 2151 |
| Haemophilia A Tyr431Asn aTAC-AAC | TATTTGAACAATGGCCCTCAGCGGATTGGTAGGAAGTACAAA AAAGTCCGATTTATGGCATACACAGATGAAACCTTTAAGACTC GTGAAGCTATTCAGCATGAATCAGGAATCTTGGGAC | 2152 |
| | GTCCCAAGATTCCTGATTCATGCTGAATAGCTTCACGAGTCTT AAAGGTTTCATCTGTGTATGCCATAAATCGGACTTTTTTGTAC TTCCTACCAATCCGCTGAGGGCCATTGTTCAAATA | 2153 |
| | TTATGGCATACACAGAT | 2154 |
| | ATCTGTGTATGCCATAA | 2155 |
| Haemophilia A Thr435Ile ACC-ATC | GCCCTCAGCGGATTGGTAGGAAGTACAAAAAAGTCCGATTTA TGGCATACACAGATGAAACCTTTAAGACTCGTGAAGCTATTCA GCATGAATCAGGAATCTTGGGACCTTTACTTTATGG | 2156 |
| | CCATAAAGTAAAGGTCCCAAGATTCCTGATTCATGCTGAATAG CTTCACGAGTCTTAAAGGTTTCATCTGTGTATGCCATAAATCG GACTTTTTTGTACTTCCTACCAATCCGCTGAGGGC | 2157 |
| | AGATGAAACCTTTAAGA | 2158 |
| | TCTTAAAGGTTTCATCT | 2159 |
| Haemophilia A Pro451Leu CCT-CTT | ACACAGATGAAACCTTTAAGACTCGTGAAGCTATTCAGCATGA ATCAGGAATCTTGGGACCTTTACTTTATGGGGAAGTTGGAGA CACACTGTTGGTAAGTTGAAGAAAAGATTTAAGGTC | 2160 |
| | GACCTTAAATCTTTTCTTCAACTTACCAACAGTGTGTCTCCAA CTTCCCCATCAAAGTAAAGGTCCCAAGATTCCTGATTCATGCTG AATAGCTTCACGAGTCTTAAAGGTTTCATCTGTGT | 2161 |

TABLE 20-continued

Factor VIII Mutations and Genome-Correcting Oligos

| Clinical Phenotype & Mutation | Correcting Oligos | SEQ ID NO: |
|---|---|---|
| | CTTGGGACCTTTACTTT | 2162 |
| | AAAGTAAAGGTCCCAAG | 2163 |
| Haemophilia A Pro451Thr aCCT-ACT | TACACAGATGAAACCTTTAAGACTCGTGAAGCTATTCAGCATG AATCAGGAATCTTGGGACCTTTACTTTATGGGAAGTTGGAGA CACACTGTTGGTAAGTTGAAGAAAAGATTTAAGGT | 2164 |
| | ACCTTAAATCTTTTCTTCAACTTACCAACAGTGTGTCTCCAACT TCCCCATAAAGTAAAGGTCCCAAGATTCCTGATTCATGCTGAA TAGCTTCACGAGTCTTAAAGGTTTCATCTGTGTA | 2165 |
| | TCTTGGGACCTTTACTT | 2166 |
| | AAGTAAAGGTCCCAAGA | 2167 |
| Haemophilia A Gly455Arg tGGG-AGG | ACCTTTAAGACTCGTGAAGCTATTCAGCATGAATCAGGAATCT TGGGACCTTTACTTTATGGGGAAGTTGGAGACACACTGTTGG TAAGTTGAAGAAAAGATTTAAGGTCAGGTAAGAAGA | 2168 |
| | TCTTCTTACCTGACCTTAAATCTTTTCTTCAACTTACCAACAGT GTGTCTCCAACTTCCCCATAAAGTAAAGGTCCCAAGATTCCTG ATTCATGCTGAATAGCTTCACGAGTCTTAAAGGT | 2169 |
| | TACTTTATGGGGAAGTT | 2170 |
| | AACTTCCCCATAAAGTA | 2171 |
| Haemophilia A Gly455Glu GGG-GAG | CCTTTAAGACTCGTGAAGCTATTCAGCATGAATCAGGAATCTT GGGACCTTTACTTTATGGGGAAGTTGGAGACACACTGTTGGT AAGTTGAAGAAAAGATTTAAGGTCAGGTAAGAAGAA | 2172 |
| | TTCTTCTTACCTGACCTTAAATCTTTTCTTCAACTTACCAACAG TGTGTCTCCAACTTCCCATAAAGTAAAGGTCCCAAGATTCCT GATTCATGCTGAATAGCTTCACGAGTCTTAAAGG | 2173 |
| | ACTTTATGGGGAAGTTG | 2174 |
| | CAACTTCCCCATAAAGT | 2175 |
| Haemophilia A Asp459Asn aGAC-AAC | CGTGAAGCTATTCAGCATGAATCAGGAATCTTGGGACCTTTAC TTTATGGGGAAGTTGGAGACACACTGTTGGTAAGTTGAAGAA AAGATTTAAGGTCAGGTAAGAAGAAAAAGTCTGGAG | 2176 |
| | CTCCAGACTTTTTCTTCTTACCTGACCTTAAATCTTTTCTTCAA CTTACCAACAGTGTGTCTCCAACTTCCCCATAAAGTAAAGGTC CCAAGATTCCTGATTCATGCTGAATAGCTTCACG | 2177 |
| | AAGTTGGAGACACACTG | 2178 |
| | CAGTGTGTCTCCAACTT | 2179 |
| Haemophilia A Phe465Cys TTT-TGT | TGTTGATCCTAGTCGTTTTAGGATTTGATCTTAGATCTCGCTTA TACTTTCAGATTATATTTAAGAATCAAGCAAGCAGACCATATAA CATCTACCCTCACGGAATCACTGATGTCCGTCC | 2180 |
| | GGACGGACATCAGTGATTCCGTGAGGGTAGATGTTATATGGT CTGCTTGCTTGATTCTTAAATATAATCTGAAAGTATAAGCGAG ATCTAAGATCAAATCCTAAAACGACTAGGATCAACA | 2181 |
| | GATTATATTTAAGAATC | 2182 |
| | GATTCTTAAATATAATC | 2183 |
| Haemophilia A Ala469Gly GCA-GGA | TCGTTTTAGGATTTGATCTTAGATCTCGCTTATACTTTCAGATT ATATTTAAGAATCAAGCAAGCAGACCATATAACATCTACCCTC ACGGAATCACTGATGTCCGTCCTTTGTATTCAAG | 2184 |
| | CTTGAATACAAAGGACGGACATCAGTGATTCCGTGAGGGTAG ATGTTATATGGTCTGCTTGCTTGATTCTTAAATATAATCTGAAA GTATAAGCGAGATCTAAGATCAAATCCTAAAACGA | 2185 |

TABLE 20-continued

Factor VIII Mutations and Genome-Correcting Oligos

| Clinical Phenotype & Mutation | Correcting Oligos | SEQ ID NO: |
|---|---|---|
| | GAATCAAGCAAGCAGAC | 2186 |
| | GTCTGCTTGCTTGATTC | 2187 |
| Haemophilia A Arg471Gly cAGA-GGA | TTAGGATTTGATCTTAGATCTCGCTTATACTTTCAGATTATATT TAAGAATCAAGCAAGCAGACCATATAACATCTACCCTCACGG AATCACTGATGTCCGTCCTTTGTATTCAAGGAGAT | 2188 |
| | ATCTCCTTGAATACAAAGGACGGACATCAGTGATTCCGTGAG GGTAGATGTTATATGGTCTGCTTGCTTGATTCTTAAATATAATC TGAAAGTATAAGCGAGATCTAAGATCAAATCCTAA | 2189 |
| | AAGCAAGCAGACCATAT | 2190 |
| | ATATGGTCTGCTTGCTT | 2191 |
| Haemophilia A Tyr473Cys TAT-TGT | TTGATCTTAGATCTCGCTTATACTTTCAGATTATATTTAAGAAT CAAGCAAGCAGACCATATAACATCTACCCTCACGGAATCACT GATGTCCGTCCTTTGTATTCAAGGAGATTACCAAA | 2192 |
| | TTTGGTAATCTCCTTGAATACAAAGGACGGACATCAGTGATTC CGTGAGGGTAGATGTTATATGGTCTGCTTGCTTGATTCTTAAA TATAATCTGAAAGTATAAGCGAGATCTAAGATCAA | 2193 |
| | CAGACCATATAACATCT | 2194 |
| | AGATGTTATATGGTCTG | 2195 |
| Haemophilia A Tyr473His aTAT-CAT | TTTGATCTTAGATCTCGCTTATACTTTCAGATTATATTTAAGAA TCAAGCAAGCAGACCATATAACATCTACCCTCACGGAATCACT GATGTCCGTCCTTTGTATTCAAGGAGATTACCAA | 2196 |
| | TTGGTAATCTCCTTGAATACAAAGGACGGACATCAGTGATTCC GTGAGGGTAGATGTTATATGGTCTGCTTGCTTGATTCTTAAAT ATAATCTGAAAGTATAAGCGAGATCTAAGATCAAA | 2197 |
| | GCAGACCATATAACATC | 2198 |
| | GATGTTATATGGTCTGC | 2199 |
| Haemophilia A Ile475Thr ATC-ACC | TTAGATCTCGCTTATACTTTCAGATTATATTTAAGAATCAAGCA AGCAGACCATATAACATCTACCCTCACGGAATCACTGATGTCC GTCCTTTGTATTCAAGGAGATTACCAAAAGGTAA | 2200 |
| | TTACCTTTTGGTAATCTCCTTGAATACAAAGGACGGACATCAG TGATTCCGTGAGGGTAGATGTTATATGGTCTGCTTGCTTGATT CTTAAATATAATCTGAAAGTATAAGCGAGATCTAA | 2201 |
| | ATATAACATCTACCCTC | 2202 |
| | GAGGGTAGATGTTATAT | 2203 |
| Haemophilia A Gly419Arg cGGA-AGA | TTATACTTTCAGATTATATTTAAGAATCAAGCAAGCAGACCATA TAACATCTACCCTCACGGAATCACTGATGTCCGTCCTTTGTAT TCAAGGAGATTACCAAAAGGTAAATATTCCCTCG | 2204 |
| | CGAGGGAATATTTACCTTTTGGTAATCTCCTTGAATACAAAGG ACGGACATCAGTGATTCCGTGAGGGTAGATGTTATATGGTCT GCTTGCTTGATTCTTAAATATAATCTGAAAGTATAA | 2205 |
| | ACCCTCACGGAATCACT | 2206 |
| | AGTGATTCCGTGAGGGT | 2207 |
| Haemophilia A Thr522Ser aACT-TCT | CCAATTCTGCCAGGAGAAATATTCAAATATAAATGGACAGTGA CTGTAGAAGATGGGCCAACTAAATCAGATCCTCGGTGCCTGA CCCGCTATTACTCTAGTTTCGTTAATATGGAGAGAG | 2208 |
| | CTCTCTCCATATTAACGAAACTAGAGTAATAGCGGGTCAGGC ACCGAGGATCTGATTTAGTTGGCCCATCTTCTACAGTCACTGT CCATTTATATTTGAATATTTCTCCTGGCAGAATTGG | 2209 |

TABLE 20-continued

Factor VIII Mutations and Genome-Correcting Oligos

| Clinical Phenotype & Mutation | Correcting Oligos | SEQ ID NO: |
|---|---|---|
| | ATGGGCCAACTAAATCA | 2210 |
| | TGATTTAGTTGGCCCAT | 2211 |
| Haemophilia A Asp525Asn aGAT-AAT | CCAGGAGAAATATTCAAATATAAATGGACAGTGACTGTAGAAG ATGGGCCAACTAAATCAGATCCTCGGTGCCTGACCCGCTATT ACTCTAGTTTCGTTAATATGGAGAGAGATCTAGCTT | 2212 |
| | AAGCTAGATCTCTCTCCATATTAACGAAACTAGAGTAATAGCG GGTCAGGCACCGAGGATCTGATTTAGTTGGCCCATCTTCTAC AGTCACTGTCCATTTATATTTGAATATTTCTCCTGG | 2213 |
| | CTAAATCAGATCCTCGG | 2214 |
| | CCGAGGATCTGATTTAG | 2215 |
| Haemophilia A Arg527Trp tCGG-TGG | GAAATATTCAAATATAAATGGACAGTGACTGTAGAAGATGGGC CAACTAAATCAGATCCTCGGTGCCTGACCCGCTATTACTCTA GTTTCGTTAATATGGAGAGAGATCTAGCTTCAGGAC | 2216 |
| | GTCCTGAAGCTAGATCTCTCTCCATATTAACGAAACTAGAGTA ATAGCGGGTCAGGCACCGAGGATCTGATTTAGTTGGCCCATC TTCTACAGTCACTGTCCATTTATATTTGAATATTTC | 2217 |
| | CAGATCCTCGGTGCCTG | 2218 |
| | CAGGCACCGAGGATCTG | 2219 |
| Haemophilia A Arg531Cys cCGC-TGC | TATAAATGGACAGTGACTGTAGAAGATGGGCCAACTAAATCA GATCCTCGGTGCCTGACCCGCTATTACTCTAGTTTCGTTAATA TGGAGAGAGATCTAGCTTCAGGACTCATTGGCCCTC | 2220 |
| | GAGGGCCAATGAGTCCTGAAGCTAGATCTCTCTCCATATTAA CGAAACTAGAGTAATAGCGGGTCAGGCACCGAGGATCTGATT TAGTTGGCCCATCTTCTACAGTCACTGTCCATTTATA | 2221 |
| | GCCTGACCCGCTATTAC | 2222 |
| | GTAATAGCGGGTCAGGC | 2223 |
| Haemophilia A Arg531Gly cCGC-GGC | TATAAATGGACAGTGACTGTAGAAGATGGGCCAACTAAATCA GATCCTCGGTGCCTGACCCGCTATTACTCTAGTTTCGTTAATA TGGAGAGAGATCTAGCTTCAGGACTCATTGGCCCTC | 2224 |
| | GAGGGCCAATGAGTCCTGAAGCTAGATCTCTCTCCATATTAA CGAAACTAGAGTAATAGCGGGTCAGGCACCGAGGATCTGATT TAGTTGGCCCATCTTCTACAGTCACTGTCCATTTATA | 2225 |
| | GCCTGACCCGCTATTAC | 2226 |
| | GTAATAGCGGGTCAGGC | 2227 |
| Haemophilia A Arg531His CGC-CAC | ATAAATGGACAGTGACTGTAGAAGATGGGCCAACTAAATCAG ATCCTCGGTGCCTGACCCGCTATTACTCTAGTTTCGTTAATAT GGAGAGAGATCTAGCTTCAGGACTCATTGGCCCTCT | 2228 |
| | AGAGGGCCAATGAGTCCTGAAGCTAGATCTCTCTCCATATTAA CGAAACTAGAGTAATAGCGGGTCAGGCACCGAGGATCTGATT TAGTTGGCCCATCTTCTACAGTCACTGTCCATTTAT | 2229 |
| | CCTGACCCGCTATTACT | 2230 |
| | AGTAATAGCGGGTCAGG | 2231 |
| Haemophilia A Ser534Pro cTCT-CCT | ACAGTGACTGTAGAAGATGGGCCAACTAAATCAGATCCTCGG TGCCTGACCCGCTATTACTCTAGTTTCGTTAATATGGAGAGAG ATCTAGCTTCAGGACTCATTGGCCCTCTCCTCATCT | 2232 |
| | AGATGAGGAGAGGGCCAATGAGTCCTGAAGCTAGATCTCTCT CCATATTAACGAAACTAGAGTAATAGCGGGTCAGGCACCGAG GATCTGATTTAGTTGGCCCATCTTCTACAGTCACTGT | 2233 |

TABLE 20-continued

Factor VIII Mutations and Genome-Correcting Oligos

| Clinical Phenotype & Mutation | Correcting Oligos | SEQ ID NO: |
|---|---|---|
| | GCTATTACTCTAGTTTC | 2234 |
| | GAAACTAGAGTAATAGC | 2235 |
| Haemophilia A Ser535Gly tAGT-GGT | GTGACTGTAGAAGATGGGCCAACTAAATCAGATCCTCGGTGC CTGACCCGCTATTACTCTAGTTTCGTTAATATGGAGAGAGATC TAGCTTCAGGACTCATTGGCCCTCTCCTCATCTGCT | 2236 |
| | AGCAGATGAGGAGAGGGCCAATGAGTCCTGAAGCTAGATCTC TCTCCATATTAACGAAACTAGAGTAATAGCGGGTCAGGCACC GAGGATCTGATTTAGTTGGCCCATCTTCTACAGTCAC | 2237 |
| | ATTACTCTAGTTTCGTT | 2238 |
| | AACGAAACTAGAGTAAT | 2239 |
| Haemophilia A Val537Asp GTT-GAT | TAGAAGATGGGCCAACTAAATCAGATCCTCGGTGCCTGACCC GCTATTACTCTAGTTTCGTTAATATGGAGAGAGATCTAGCTTC AGGACTCATTGGCCCTCTCCTCATCTGCTACAAAGA | 2240 |
| | TCTTTGTAGCAGATGAGGAGAGGGCCAATGAGTCCTGAAGCT AGATCTCTCTCCATATTAACGAAACTAGAGTAATAGCGGGTCA GGCACCGAGGATCTGATTTAGTTGGCCCATCTTCTA | 2241 |
| | TAGTTTCGTTAATATGG | 2242 |
| | CCATATTAACGAAACTA | 2243 |
| Haemophilia A Arg541Thr AGA-ACA | CAACTAAATCAGATCCTCGGTGCCTGACCCGCTATTACTCTA GTTTCGTTAATATGGAGAGAGATCTAGCTTCAGGACTCATTGG CCCTCTCCTCATCTGCTACAAAGAATCTGTAGATCA | 2244 |
| | TGATCTACAGATTCTTTGTAGCAGATGAGGAGAGGGCCAATG AGTCCTGAAGCTAGATCTCTCTCCATATTAACGAAACTAGAGT AATAGCGGGTCAGGCACCGAGGATCTGATTTAGTTG | 2245 |
| | TATGGAGAGAGATCTAG | 2246 |
| | CTAGATCTCTCTCCATA | 2247 |
| Haemophilia A Asp542Gly GAT-GGT | CTAAATCAGATCCTCGGTGCCTGACCCGCTATTACTCTAGTTT CGTTAATATGGAGAGAGATCTAGCTTCAGGACTCATTGGCCC TCTCCTCATCTGCTACAAAGAATCTGTAGATCAAAG | 2248 |
| | CTTTGATCTACAGATTCTTTGTAGCAGATGAGGAGAGGGCCA ATGAGTCCTGAAGCTAGATCTCTCCATATTAACGAAACTAG AGTAATAGCGGGTCAGGCACCGAGGATCTGATTTAG | 2249 |
| | GGAGAGAGATCTAGCTT | 2250 |
| | AAGCTAGATCTCTCTCC | 2251 |
| Haemophilia A Asp542His aGAT-CAT | ACTAAATCAGATCCTCGGTGCCTGACCCGCTATTACTCTAGTT TCGTTAATATGGAGAGAGATCTAGCTTCAGGACTCATTGGCC CTCTCCTCATCTGCTACAAAGAATCTGTAGATCAAA | 2252 |
| | TTTGATCTACAGATTCTTTGTAGCAGATGAGGAGAGGGCCAAT GAGTCCTGAAGCTAGATCTCTCTCCATATTAACGAAACTAGAG TAATAGCGGGTCAGGCACCGAGGATCTGATTTAGT | 2253 |
| | TGGAGAGAGATCTAGCT | 2254 |
| | AGCTAGATCTCTCTCCA | 2255 |
| Haemophilia A Asp542Tyr aGAT-TAT | ACTAAATCAGATCCTCGGTGCCTGACCCGCTATTACTCTAGTT TCGTTAATATGGAGAGAGATCTAGCTTCAGGACTCATTGGCC CTCTCCTCATCTGCTACAAAGAATCTGTAGATCAAA | 2256 |
| | TTTGATCTACAGATTCTTTGTAGCAGATGAGGAGAGGGCCAAT GAGTCCTGAAGCTAGATCTCTCTCCATATTAACGAAACTAGAG TAATAGCGGGTCAGGCACCGAGGATCTGATTTAGT | 2257 |

TABLE 20-continued

Factor VIII Mutations and Genome-Correcting Oligos

| Clinical Phenotype & Mutation | Correcting Oligos | SEQ ID NO: |
|---|---|---|
| | TGGAGAGAGATCTAGCT | 2258 |
| | AGCTAGATCTCTCTCCA | 2259 |
| Haemophilia A Glu557Term aGAA-TAA | GTTAATATGGAGAGAGATCTAGCTTCAGGACTCATTGGCCCT CTCCTCATCTGCTACAAAGAATCTGTAGATCAAAGAGGAAACC AGGTGAGTTCTTGCCTTTCCAAGTGCTGGGTTTCAT | 2260 |
| | ATGAAACCCAGCACTTGGAAAGGCAAGAACTCACCTGGTTTC CTCTTTGATCTACAGATTCTTTGTAGCAGATGAGGAGAGGGC CAATGAGTCCTGAAGCTAGATCTCTCTCCATATTAAC | 2261 |
| | GCTACAAAGAATCTGTA | 2262 |
| | TACAGATTCTTTGTAGC | 2263 |
| Haemophilia A Ser558Phe TCT-TTT | ATATGGAGAGAGATCTAGCTTCAGGACTCATTGGCCCTCTCC TCATCTGCTACAAAGAATCTGTAGATCAAAGAGGAAACCAGGT CAGTTCTTGCCTTTCCAAGTGCTGGGTTTCATTCTC | 2264 |
| | GAGAATGAAACCCAGCACTTGGAAAGGCAAGAACTCACCTGG TTTCCTCTTTGATCTACAGATTCTTTGTAGCAGATGAGGAGAG GGCCAATGAGTCCTGAAGCTAGATCTCTCTCCATAT | 2265 |
| | CAAAGAATCTGTAGATC | 2266 |
| | GATCTACAGATTCTTTG | 2267 |
| Haemophilia A Val559Ala GTA-GCA | TGGAGAGAGATCTAGCTTCAGGACTCATTGGCCCTCTCCTCA TCTGCTACAAAGAATCTGTAGATCAAAGAGGAAACCAGGTGA GTTCTTGCCTTTCCAAGTGCTGGGTTTCATTCTCAGT | 2268 |
| | ACTGAGAATGAAACCCAGCACTTGGAAAGGCAAGAACTCACC TGGTTTCCTCTTTGATCTACAGATTCTTTGTAGCAGATGAGGA GAGGGCCAATGAGTCCTGAAGCTAGATCTCTCTCCA | 2269 |
| | AGAATCTGTAGATCAAA | 2270 |
| | TTTGATCTACAGATTCT | 2271 |

EXAMPLE 14

Hemophilia—Factor IX Deficiency

The attached table discloses the correcting oligonucleotide base sequences for the Factor IX oligonucleotides of the invention.

TABLE 21

Factor IX Mutations and Genome-Correcting Oligos

| Clinical Phenotype & Mutation | Correcting Oligos | SEQ ID NO: |
|---|---|---|
| Haemophilia B Asn2Asp tAAT-GAT | ATTTCAGTTTTTCTTGATCATGAAAACGCCAACAAAATTCTGAA TCGGCCAAAGAGGTATAATTCAGGTAAATTGGAAGAGTTTGTT CAAGGGAACCTTGAGAGAGAATGTATGGAAGAAA | 2272 |
| | TTTCTTCCATACATTCTCTCTCAAGGTTCCCTTGAACAAACTCT TCCAATTTACCTGAATTATACCTCTTTGGCCGATTCAGAATTTT GTTGGCGTTTTCATGATCAAGAAAAACTGAAAT | 2273 |
| | AGAGGTATAATTCAGGT | 2274 |
| | ACCTGAATTATACCTCT | 2275 |

TABLE 21-continued

Factor IX Mutations and Genome-Correcting Oligos

| Clinical Phenotype & Mutation | Correcting Oligos | SEQ ID NO: |
|---|---|---|
| Haemophilia B Asn2Ile AAT-ATT | TTTCAGTTTTTCTTGATCATGAAAACGCCAACAAAATTCTGAAT CGGCCAAAGAGGTATAATTCAGGTAAATTGGAAGAGTTTGTT CAAGGGAACCTTGAGAGAGAATGTATGGAAGAAAA | 2276 |
| | TTTTCTTCCATACATTCTCTCTCAAGGTTCCCTTGAACAAACTC TTCCAATTTACCTGAATTATACCTCTTTGGCCGATTCAGAATTT TGTTGGCGTTTTCATGATCAAGAAAAACTGAAA | 2277 |
| | GAGGTATAATTCAGGTA | 2278 |
| | TACCTGAATTATACCTC | 2279 |
| Haemophilia B Asn2Tyr tAAT-TAT | ATTTCAGTTTTTCTTGATCATGAAAACGCCAACAAAATTCTGAA TCGGCCAAAGAGGTATAATTCAGGTAAATTGGAAGAGTTTGTT CAAGGGAACCTTGAGAGAGAATGTATGGAAGAAA | 2280 |
| | TTTCTTCCATACATTCTCTCTCAAGGTTCCCTTGAACAAACTCT TCCAATTTACCTGAATTATACCTCTTTGGCCGATTCAGAATTTT GTTGGCGTTTTCATGATCAAGAAAAACTGAAAT | 2281 |
| | AGAGGTATAAATTCAGGT | 2282 |
| | ACCTGAATTATACCTCT | 2283 |
| Haemophilia B Ser3Pro tTCA-CCA | TCAGTTTTTCTTGATCATGAAAACGCCAACAAAATTCTGAATC GGCCAAAGAGGTATAATTCAGGTAAATTGGAAGAGTTTGTTCA AGGGAACCTTGAGAGAGAATGTATGGAAGAAAAGT | 2284 |
| | ACTTTTCTTCCATACATTCTCTCTCAAGGTTCCCTTGAACAAAC TCTTCCAATTTACCTGAATTATACCTCTTTGGCCGATTCAGAA TTTTGTTGGCGTTTTCATGATCAAGAAAAACTGA | 2285 |
| | GGTATAATTCAGGTAAA | 2286 |
| | TTTACCTGAATTATACC | 2287 |
| Haemophilia B Gly4Asp GGT-GAT | TTTTTCTTGATCATGAAAACGCCAACAAAATTCTGAATCGGCC AAAGAGGTATAATTCAGGTAAATTGGAAGAGTTTGTTCAAGGG AACCTTGAGAGAGAATGTATGGAAGAAAAGTGTAG | 2288 |
| | CTACACTTTTCTTCCATACATTCTCTCTCAAGGTTCCCTTGAAC AAACTCTTCCAATTTACCTGAATTATACCTCTTTGGCCGATTCA GAATTTTGTTGGCGTTTTCATGATCAAGAAAA | 2289 |
| | TAATTCAGGTAAATTGG | 2290 |
| | CCAATTTACCTGAATTA | 2291 |
| Haemophilia B Gly4Ser aGGT-AGT | GTTTTTCTTGATCATGAAAACGCCAACAAAATTCTGAATCGGC CAAAGAGGTATAATTCAGGTAAATTGGAAGAGTTTGTTCAAGG GAACCTTGAGAGAGAATGTATGGAAGAAAAGTGTA | 2292 |
| | TACACTTTTCTTCCATACATTCTCTCTCAAGGTTCCCTTGAACA AACTCTTCCAATTTACCTGAATTATACCTCTTTGGCCGATTCA GAATTTTGTTGGCGTTTTCATGATCAAGAAAAAC | 2293 |
| | ATAATTCAGGTAAATTG | 2294 |
| | CAATTTACCTGAATTAT | 2295 |
| Haemophilia B Lys5Glu tAAA-GAA | TTTCTTGATCATGAAAACGCCAACAAAATTCTGAATCGGCCAA AGAGGTATAATTCAGGTAAATTGGAAGAGTTTGTTCAAGGGAA CCTTGAGAGAGAATGTATGGAAGAAAAGTGTAGTT | 2296 |
| | AACTACACTTTTCTTCCATACATTCTCTCTCAAGGTTCCCTTGA ACAAACTCTTCCAATTTACCTGAATTATACCTCTTTGGCCGATT CAGAATTTTGTTGGCGTTTTCATGATCAAGAAA | 2297 |
| | ATTCAGGTAAATTGGAA | 2298 |
| | TTCCAATTTACCTGAAT | 2299 |
| Haemophilia B | ATCATGAAAACGCCAACAAAATTCTGAATCGGCCAAAGAGGTA | 2300 |

TABLE 21-continued

Factor IX Mutations and Genome-Correcting Oligos

| Clinical Phenotype & Mutation | Correcting Oligos | SEQ ID NO: |
|---|---|---|
| Glu7Ala GAA-GCA | TAATTCAGGTAAATTGGAAGAGTTTGTTCAAGGGAACCTTGAG AGAGAATGTATGGAAGAAAAGTGTAGTTTTGAAGA | |
| | TCTTCAAAACTACACTTTTCTTCCATACATTCTCTCTCAAGGTT CCCTTGAACAAACTCTTCCAATTTACCTGAATTATACCTCTTTG GCCGATTCAGAATTTTGTTGGCGTTTTCATGAT | 2301 |
| | TAAATTGGAAGAGTTTG | 2302 |
| | CAAACTCTTCCAATTTA | 2303 |
| Haemophilia B Glu7Lys gGAA-AAA | GATCATGAAAACGCCAACAAAATTCTGAATCGGCCAAAGAGG TATAATTCAGGTAAATTGGAAGAGTTTGTTCAAGGGAACCTTG AGAGAGAATGTATGGAAGAAAAGTGTAGTTTTGAAG | 2304 |
| | CTTCAAAACTACACTTTTCTTCCATACATTCTCTCTCAAGGTTC CCTTGAACAAACTCTTCCAATTTACCTGAATTATACCTCTTTGG CCGATTCAGAATTTTGTTGGCGTTTTCATGATC | 2305 |
| | GTAAATTGGAAGAGTTT | 2306 |
| | AAACTCTTCCAATTTAC | 2307 |
| Haemophilia B Glu7Val GAA-GTA | ATCATGAAAACGCCAACAAAATTCTGAATCGGCCAAAGAGGTA TAATTCAGGTAAATTGGAAGAGTTTGTTCAAGGGAACCTTGAG AGAGAATGTATGGAAGAAAAGTGTAGTTTTGAAGA | 2308 |
| | TCTTCAAAACTACACTTTTCTTCCATACATTCTCTCTCAAGGTT CCCTTGAACAAACTCTTCCAATTTACCTGAATTATACCTCTTTG GCCGATTCAGAATTTTGTTGGCGTTTTCATGAT | 2309 |
| | TAAATTGGAAGAGTTTG | 2310 |
| | CAAACTCTTCCAATTTA | 2311 |
| Haemophilia B Glu8Ala GAG-GCG | ATGAAAACGCCAACAAAATTCTGAATCGGCCAAAGAGGTATAA TTCAGGTAAATTGGAAGAGTTTGTTCAAGGGAACCTTGAGAG AGAATGTATGGAAGAAAAGTGTAGTTTTGAAGAAGC | 2312 |
| | GCTTCTTCAAAACTACACTTTTCTTCCATACATTCTCTCTCAAG GTTCCCTTGAACAAACTCTTCCAATTTACCTGAATTATACCTCT TTGGCCGATTCAGAATTTTGTTGGCGTTTTCAT | 2313 |
| | ATTGGAAGAGTTTGTTC | 2314 |
| | GAACAAACTCTTCCAAT | 2315 |
| Haemophilia B Glu8Gly GAG-GGG | ATGAAAACGCCAACAAAATTCTGAATCGGCCAAAGAGGTATAA TTCAGGTAAATTGGAAGAGTTTGTTCAAGGGAACCTTGAGAG AGAATGTATGGAAGAAAAGTGTAGTTTTGAAGAAGC | 2316 |
| | GCTTCTTCAAAACTACACTTTTCTTCCATACATTCTCTCTCAAG GTTCCCTTGAACAAACTCTTCCAATTTACCTGAATTATACCTCT TTGGCCGATTCAGAATTTTGTTGGCGTTTTCAT | 2317 |
| | ATTGGAAGAGTTTGTTC | 2318 |
| | GAACAAACTCTTCCAAT | 2319 |
| Haemophilia B Phe9Cys TTT-TGT | AAAACGCCAACAAAATTCTGAATCGGCCAAAGAGGTATAATTC AGGTAAATTGGAAGAGTTTGTTCAAGGGAACCTTGAGAGAGA ATGTATGGAAGAAAAGTGTAGTTTTGAAGAAGCACG | 2320 |
| | CGTGCTTCTTCAAAACTACACTTTTCTTCCATACATTCTCTCTC AAGGTTCCCTTGAACAAACTCTTCCAATTTACCTGAATTATAC CTCTTTGGCCGATTCAGAATTTTGTTGGCGTTTT | 2321 |
| | GGAAGAGTTTGTTCAAG | 2322 |
| | CTTGAACAAACTCTTCC | 2323 |
| Haemophilia B Phe9Ile gTTT-ATT | GAAAACGCCAACAAAATTCTGAATCGGCCAAAGAGGTATAATT CAGGTAAATTGGAAGAGTTTGTTCAAGGGAACCTTGAGAGAG AATGTATGGAAGAAAAGTGTAGTTTTGAAGAAGCAC | 2324 |

TABLE 21-continued

Factor IX Mutations and Genome-Correcting Oligos

| Clinical Phenotype & Mutation | Correcting Oligos | SEQ ID NO: |
|---|---|---|
| | GTGCTTCTTCAAAACTACACTTTTCTTCCATACATTCTCTCTCA AGGTTCCCTTGAACAAACTCTTCCAATTTACCTGAATTATACC TCTTTGGCCGATTCAGAATTTTGTTGGCGTTTTC | 2325 |
| | TGGAAGAGTTTGTTCAA | 2326 |
| | TTGAACAAACTCTTCCA | 2327 |
| Haemophilia B Arg(-1)Ser AGGt-AGC | TTACATTTCAGTTTTTCTTGATCATGAAAACGCCAACAAAATTC TGAATCGGCCAAAGAGGTATAATTCAGGTAAATTGGAAGAGTT TGTTCAAGGGAACCTTGAGAGAGAATGTATGGAA | 2328 |
| | TTCCATACATTCTCTCTCAAGGTTCCCTTGAACAAACTCTTCC AATTTACCTGAATTATACCTCTTTGGCCGATTCAGAATTTTGTT GGCGTTTTCATGATCAAGAAAAACTGAAATGTAA | 2329 |
| | CCAAAGAGGTATAATTC | 2330 |
| | GAATTATACCTCTTTGG | 2331 |
| Haemophilia B Arg(-1)Thr AGG-ACG | TTTACATTTCAGTTTTTCTTGATCATGAAAACGCCAACAAAATT CTGAATCGGCCAAAGAGGTATAATTCAGGTAAATTGGAAGAG TTTGTTCAAGGGAACCTTGAGAGAGAATGTATGGA | 2332 |
| | TCCATACATTCTCTCTCAAGGTTCCCTTGAACAAACTCTTCCA ATTTACCTGAATTATACCTCTTTGGCCGATTCAGAATTTTGTTG GCGTTTTCATGATCAAGAAAAACTGAAATGTAAA | 2333 |
| | GCCAAAGAGGTATAATT | 2334 |
| | AATTATACCTCTTTGGC | 2335 |
| Haemophilia B Lys(-2)Asn AAGa-AAT | CTTTTACATTTCAGTTTTTCTTGATCATGAAAACGCCAACAAA TTCTGAATCGGCCAAAGAGGTATAATTCAGGTAAATTGGAAGA GTTTGTTCAAGGGAACCTTGAGAGAGAATGTATG | 2336 |
| | CATACATTCTCTCTCAAGGTTCCCTTGAACAAACTCTTCCAAT TTACCTGAATTATACCTCTTTGGCCGATTCAGAATTTTGTTGG CGTTTTCATGATCAAGAAAAACTGAAATGTAAAG | 2337 |
| | CGGCCAAAGAGGTATAA | 2338 |
| | TTATACCTCTTTGGCCG | 2339 |
| Haemophilia B Arg(-4)Gln CGG-CAG | AATTATTCTTTTACATTTCAGTTTTTCTTGATCATGAAAACGCC AACAAAATTCTGAATCGGCCAAAGAGGTATAATTCAGGTAAAT TGGAAGAGTTTGTTCAAGGGAACCTTGAGAGAGA | 2340 |
| | TCTCTCTCAAGGTTCCCTTGAACAAACTCTTCCAATTTACCTG AATTATACCTCTTTGGCCGATTCAGAATTTTGTTGGCGTTTTCA TGATCAAGAAAAACTGAAATGTAAAGAATAATT | 2341 |
| | TCTGAATCGGCCAAAGA | 2342 |
| | TCTTTGGCCGATTCAGA | 2343 |
| Haemophilia B Arg(-4)Leu CGG-CTG | AATTATTCTTTTACATTTCAGTTTTTCTTGATCATGAAAACGCC AACAAAATTCTGAATCGGCCAAAGAGGTATAATTCAGGTAAAT TGGAAGAGTTTGTTCAAGGGAACCTTGAGAGAGA | 2344 |
| | TCTCTCTCAAGGTTCCCTTGAACAAACTCTTCCAATTTACCTG AATTATACCTCTTTGGCCGATTCAGAATTTTGTTGGCGTTTTCA TGATCAAGAAAAACTGAAATGTAAAGAATAATT | 2345 |
| | TCTGAATCGGCCAAAGA | 2346 |
| | TCTTTGGCCGATTCAGA | 2347 |
| Haemophilia B Arg(-4)Trp tCGG-TGG | GAATTATTCTTTTACATTTCAGTTTTTCTTGATCATGAAAACGC CAACAAAATTCTGAATCGGCCAAAGAGGTATAATTCAGGTAAA TTGGAAGAGTTTGTTCAAGGGAACCTTGAGAGAG | 2348 |
| | CTCTCTCAAGGTTCCCTTGAACAAACTCTTCCAATTTACCTGA | 2349 |

TABLE 21-continued

Factor IX Mutations and Genome-Correcting Oligos

| Clinical Phenotype & Mutation | Correcting Oligos | SEQ ID NO: |
|---|---|---|
| | ATTATACCTCTTTGGCCGATTCAGAATTTTGTTGGCGTTTTCAT GATCAAGAAAAACTGAAATGTAAAAGAATAATTC | |
| | TTCTGAATCGGCCAAAG | 2350 |
| | CTTTGGCCGATTCAGAA | 2351 |
| Haemophilia B Gln11Term tCAA-TAA | GCCAACAAAATTCTGAATCGGCCAAAGAGGTATAATTCAGGTA AATTGGAAGAGTTTGTTCAAGGGAACCTTGAGAGAGAATGTAT GGAAGAAAAGTGTAGTTTTGAAGAAGCACGAGAAG | 2352 |
| | CTTCTCGTGCTTCTTCAAAACTACACTTTTCTTCCATACATTCT CTCTCAAGGTTCCCTTGAACAAACTCTTCCAATTTACCTGAAT TATACCTCTTTGGCCGATTCAGAATTTTGTTGGC | 2353 |
| | AGTTTGTTCAAGGGAAC | 2354 |
| | GTTCCCTTGAACAAACT | 2355 |
| Haemophilia B Gly12Ala GGG-GCG | ACAAAATTCTGAATCGGCCAAAGAGGTATAATTCAGGTAAATT GGAAGAGTTTGTTCAAGGGAACCTTGAGAGAGAATGTATGGA AGAAAAGTGTAGTTTTGAAGAAGCACGAGAAGTTTT | 2356 |
| | AAAACTTCTCGTGCTTCTTCAAAACTACACTTTTCTTCCATACA TTCTCTCTCAAGGTTCCCTTGAACAAACTCTTCCAATTTACCT GAATTATACCTCTTTGGCCGATTCAGAATTTTGT | 2357 |
| | TGTTCAAGGGAACCTTG | 2358 |
| | CAAGGTTCCCTTGAACA | 2359 |
| Haemophilia B Gly12Arg aGGG-AGG | AACAAAATTCTGAATCGGCCAAAGAGGTATAATTCAGGTAAAT TGGAAGAGTTTGTTCAAGGGAACCTTGAGAGAGAATGTATGG AAGAAAAGTGTAGTTTTGAAGAAGCACGAGAAGTTT | 2360 |
| | AAACTTCTCGTGCTTCTTCAAAACTACACTTTTCTTCCATACAT TCTCTCTCAAGGTTCCCTTGAACAAACTCTTCCAATTTACCTG AATTATACCTCTTTGGCCGATTCAGAATTTTGTT | 2361 |
| | TTGTTCAAGGGAACCTT | 2362 |
| | AAGGTTCCCTTGAACAA | 2363 |
| Haemophilia B Gly12Glu GGG-GAG | ACAAAATTCTGAATCGGCCAAAGAGGTATAATTCAGGTAAATT GGAAGAGTTTGTTCAAGGGAACCTTGAGAGAGAATGTATGGA AGAAAAGTGTAGTTTTGAAGAAGCACGAGAAGTTTT | 2364 |
| | AAAACTTCTCGTGCTTCTTCAAAACTACACTTTTCTTCCATACA TTCTCTCTCAAGGTTCCCTTGAACAAACTCTTCCAATTTACCT GAATTATACCTCTTTGGCCGATTCAGAATTTTGT | 2365 |
| | TGTTCAAGGGAACCTTG | 2366 |
| | CAAGGTTCCCTTGAACA | 2367 |
| Haemophilia B Glu17Gln aGAA-CAA | CGGCCAAAGAGGTATAATTCAGGTAAATTGGAAGAGTTTGTTC AAGGGAACCTTGAGAGAGAATGTATGGAAGAAAAGTGTAGTT TTGAAGAAGCACGAGAAGTTTTTGAAAACACTGAAA | 2368 |
| | TTTCAGTGTTTTCAAAAACTTCTCGTGCTTCTTCAAAACTACAC TTTTCTTCCATACATTCTCTCTCAAGGTTCCCTTGAACAAACTC TTCCAATTTACCTGAATTATACCTCTTTGGCCG | 2369 |
| | TTGAGAGAGAATGTATG | 2370 |
| | CATACATTCTCTCTCAA | 2371 |
| Haemophilia B Glu17Lys aGAA-AAA | CGGCCAAAGAGGTATAATTCAGGTAAATTGGAAGAGTTTGTTC AAGGGAACCTTGAGAGAGAATGTATGGAAGAAAAGTGTAGTT TTGAAGAAGCACGAGAAGTTTTTGAAAACACTGAAA | 2372 |
| | TTTCAGTGTTTTCAAAAACTTCTCGTGCTTCTTCAAAACTACAC TTTTCTTCCATACATTCTCTCTCAAGGTTCCCTTGAACAAACTC TTCCAATTTACCTGAATTATACCTCTTTGGCCG | 2373 |

TABLE 21-continued

Factor IX Mutations and Genome-Correcting Oligos

| Clinical Phenotype & Mutation | Correcting Oligos | SEQ ID NO: |
|---|---|---|
| | TTGAGAGAGAATGTATG | 2374 |
| | CATACATTCTCTCTCAA | 2375 |
| Haemophilia B Cys18Arg aTGT-CGT | CCAAAGAGGTATAATTCAGGTAAATTGGAAGAGTTTGTTCAAG GGAACCTTGAGAGAGAATGTATGGAAGAAAAGTGTAGTTTTG AAGAAGCACGAGAAGTTTTTGAAAACACTGAAAGAA | 2376 |
| | TTCTTTCAGTGTTTTCAAAAACTTCTCGTGCTTCTTCAAAACTA CACTTTTCTTCCATACATTCTCTCTCAAGGTTCCCTTGAACAA ACTCTTCCAATTTACCTGAATTATACCTCTTTGG | 2377 |
| | AGAGAGAATGTATGGAA | 2378 |
| | TTCCATACATTCTCTCT | 2379 |
| Haemophilia B Cys18Tyr TGT-TAT | CAAAGAGGTATAATTCAGGTAAATTGGAAGAGTTTGTTCAAGG GAACCTTGAGAGAGAATGTATGGAAGAAAAGTGTAGTTTTGAA GAAGCACGAGAAGTTTTTGAAAACACTGAAAGAAC | 2380 |
| | GTTCTTTCAGTGTTTTCAAAAACTTCTCGTGCTTCTTCAAAACT ACACTTTTCTTCCATACATTCTCTCTCAAGGTTCCCTTGAACAA ACTCTTCCAATTTACCTGAATTATACCTCTTTG | 2381 |
| | GAGAGAATGTATGGAAG | 2382 |
| | CTTCCATACATTCTCTC | 2383 |
| Haemophilia B Glu20Val GAA-GTA | GGTATAATTCAGGTAAATTGGAAGAGTTTGTTCAAGGGAACCT TGAGAGAGAATGTATGGAAGAAAAGTGTAGTTTTGAAGAAGC ACGAGAAGTTTTTGAAAACACTGAAAGAACAGTGAG | 2384 |
| | CTCACTGTTCTTTCAGTGTTTTCAAAAACTTCTCGTGCTTCTTC AAAACTACACTTTTCTTCCATACATTCTCTCTCAAGGTTCCCTT GAACAAACTCTTCCAATTTACCTGAATTATACC | 2385 |
| | ATGTATGGAAGAAAAGT | 2386 |
| | ACTTTTCTTCCATACAT | 2387 |
| Haemophilia B Glu21Lys aGAA-AAA | TATAATTCAGGTAAATTGGAAGAGTTTGTTCAAGGGAACCTTG AGAGAGAATGTATGGAAGAAAAGTGTAGTTTTGAAGAAGCAC GAGAAGTTTTTGAAAACACTGAAAGAACAGTGAGTA | 2388 |
| | TACTCACTGTTCTTTCAGTGTTTTCAAAAACTTCTCGTGCTTCT TCAAAACTACACTTTTCTTCCATACATTCTCTCTCAAGGTTCCC TTGAACAAACTCTTCCAATTTACCTGAATTATA | 2389 |
| | GTATGGAAGAAAAGTGT | 2390 |
| | ACACTTTTCTTCCATAC | 2391 |
| Haemophilia B Cys23Arg gTGT-CGT | TCAGGTAAATTGGAAGAGTTTGTTCAAGGGAACCTTGAGAGA GAATGTATGGAAGAAAAGTGTAGTTTTGAAGAAGCACGAGAA GTTTTTGAAAACACTGAAAGAACAGTGAGTATTTCCA | 2392 |
| | TGGAAATACTCACTGTTCTTTCAGTGTTTTCAAAAACTTCTCGT GCTTCTTCAAAACTACACTTTTCTTCCATACATTCTCTCTCAAG GTTCCCTTGAACAAACTCTTCCAATTTACCTGA | 2393 |
| | AAGAAAAGTGTAGTTTT | 2394 |
| | AAAACTACACTTTTCTT | 2395 |
| Haemophilia B Cys23Tyr TGT-TAT | CAGGTAAATTGGAAGAGTTTGTTCAAGGGAACCTTGAGAGAG AATGTATGGAAGAAAAGTGTAGTTTTGAAGAAGCACGAGAAGT TTTGAAAACACTGAAAGAACAGTGAGTATTTCCAC | 2396 |
| | GTGGAAATACTCACTGTTCTTTCAGTGTTTTCAAAAACTTCTC GTGCTTCTTCAAAACTACACTTTTCTTCCATACATTCTCTCTCA AGGTTCCCTTGAACAAACTCTTCCAATTTACCTG | 2397 |

TABLE 21-continued

Factor IX Mutations and Genome-Correcting Oligos

| Clinical Phenotype & Mutation | Correcting Oligos | SEQ ID NO: |
|---|---|---|
| | AGAAAAGTGTAGTTTTG | 2398 |
| | CAAAACTACACTTTTCT | 2399 |
| Haemophilia B Phe25Ser TTT-TCT | AATTGGAAGAGTTTGTTCAAGGGAACCTTGAGAGAGAATGTAT GGAAGAAAAGTGTAGTTTTGAAGAAGCACGAGAAGTTTTTGAA AACACTGAAAGAACAGTGAGTATTTCCACATAATA | 2400 |
| | TATTATGTGGAAATACTCACTGTTCTTTCAGTGTTTTCAAAAAC TTCTCGTGCTTCTTCAAAACTACACTTTTCTTCCATACATTCTC TCTCAAGGTTCCCTTGAACAAACTCTTCCAATT | 2401 |
| | GTGTAGTTTTGAAGAAG | 2402 |
| | CTTCTTCAAAACTACAC | 2403 |
| Haemophilia B Glu26Gln tGAA-CAA | TTGGAAGAGTTTGTTCAAGGGAACCTTGAGAGAGAATGTATG GAAGAAAAGTGTAGTTTTGAAGAAGCACGAGAAGTTTTTGAAA ACACTGAAAGAACAGTGAGTATTTCCACATAATACC | 2404 |
| | GGTATTATGTGGAAATACTCACTGTTCTTTCAGTGTTTTCAAAA ACTTCTCGTGCTTCTTCAAAACTACACTTTTCTTCCATACATTC TCTCTCAAGGTTCCCTTGAACAAACTCTTCCAA | 2405 |
| | GTAGTTTTGAAGAAGCA | 2406 |
| | TGCTTCTTCAAAACTAC | 2407 |
| Haemophilia B Glu27Ala GAA-GCA | AAGAGTTTGTTCAAGGGAACCTTGAGAGAGAATGTATGGAAG AAAAGTGTAGTTTTGAAGAAGCACGAGAAGTTTTTGAAAACAC TGAAAGAACAGTGAGTATTTCCACATAATACCCTTC | 2408 |
| | GAAGGGTATTATGTGGAAATACTCACTGTTCTTTCAGTGTTTT CAAAAACTTCTCGTGCTTCTTCAAAACTACACTTTTCTTCCATA CATTCTCTCTCAAGGTTCCCTTGAACAAACTCTT | 2409 |
| | TTTTGAAGAAGCACGAG | 2410 |
| | CTCGTGCTTCTTCAAAA | 2411 |
| Haemophilia B Glu27Asp GAAg-GAC | AGAGTTTGTTCAAGGGAACCTTGAGAGAGAATGTATGGAAGA AAAGTGTAGTTTTGAAGAAGCACGAGAAGTTTTTGAAAACACT GAAAGAACAGTGAGTATTTCCACATAATACCCTTCA | 2412 |
| | TGAAGGGTATTATGTGGAAATACTCACTGTTCTTTCAGTGTTT TCAAAAACTTCTCGTGCTTCTTCAAAACTACACTTTTCTTCCAT ACATTCTCTCTCAAGGTTCCCTTGAACAAACTCT | 2413 |
| | TTTGAAGAAGCACGAGA | 2414 |
| | TCTCGTGCTTCTTCAAA | 2415 |
| Haemophilia B Glu27Lys aGAA-AAA | GAAGAGTTTGTTCAAGGGAACCTTGAGAGAGAATGTATGGAA GAAAAGTGTAGTTTTGAAGAAGCACGAGAAGTTTTTGAAAACA CTGAAAGAACAGTGAGTATTTCCACATAATACCCTT | 2416 |
| | AAGGGTATTATGTGGAAATACTCACTGTTCTTTCAGTGTTTTC AAAAACTTCTCGTGCTTCTTCAAAACTACACTTTTCTTCCATAC ATTCTCTCTCAAGGTTCCCTTGAACAAACTCTTC | 2417 |
| | GTTTTGAAGAAGCACGA | 2418 |
| | TCGTGCTTCTTCAAAAC | 2419 |
| Haemophilia B Glu27Val GAA-GTA | AAGAGTTTGTTCAAGGGAACCTTGAGAGAGAATGTATGGAAG AAAAGTGTAGTTTTGAAGAAGCACGAGAAGTTTTTGAAAACAC TGAAAGAACAGTGAGTATTTCCACATAATACCCTTC | 2420 |
| | GAAGGGTATTATGTGGAAATACTCACTGTTCTTTCAGTGTTTT CAAAAACTTCTCGTGCTTCTTCAAAACTACACTTTTCTTCCATA CATTCTCTCTCAAGGTTCCCTTGAACAAACTCTT | 2421 |

TABLE 21-continued

Factor IX Mutations and Genome-Correcting Oligos

| Clinical Phenotype & Mutation | Correcting Oligos | SEQ ID NO: |
|---|---|---|
| | TTTTGAAGAAGCACGAG | 2422 |
| | CTCGTGCTTCTTCAAAA | J2423 |
| Haemophilia B Arg29Gln CGA-CAA | TTGTTCAAGGGAACCTTGAGAGAGAATGTATGGAAGAAAAGT GTAGTTTTGAAGAAGCACGAGAAGTTTTTGAAAACACTGAAAG AACAGTGAGTATTTCCACATAATACCCTTCAGATGC | 2424 |
| | GCATCTGAAGGGTATTATGTGGAAATACTCACTGTTCTTTCAG TGTTTTCAAAAACTTCTCGTGCTTCTTCAAAACTACACTTTTCT TCCATACATTCTCTCTCAAGGTTCCCTTGAACAA | 2425 |
| | AGAAGCACGAGAAGTTT | 2426 |
| | AAACTTCTCGTGCTTCT | 2427 |
| Haemophilia B Arg29Pro CGA-CCA | TTGTTCAAGGGAACCTTGAGAGAGAATGTATGGAAGAAAAGT GTAGTTTTGAAGAAGCACGAGAAGTTTTTGAAAACACTGAAAG AACAGTGAGTATTTCCACATAATACCCTTCAGATGC | 2428 |
| | GCATCTGAAGGGTATTATGTGGAAATACTCACTGTTCTTTCAG TGTTTTCAAAAACTTCTCGTGCTTCTTCAAAACTACACTTTTCT TCCATACATTCTCTCTCAAGGTTCCCTTGAACAA | 2429 |
| | AGAAGCACGAGAAGTTT | 2430 |
| | AAACTTCTCGTGCTTCT | 2431 |
| Haemophilia B Arg29Term aCGA-TGA | TTTGTTCAAGGGAACCTTGAGAGAGAATGTATGGAAGAAAAGT GTAGTTTTGAAGAAGCACGAGAAGTTTTTGAAAACACTGAAAG AACAGTGAGTATTTCCACATAATACCCTTCAGATG | 2432 |
| | CATCTGAAGGGTATTATGTGGAAATACTCACTGTTCTTTCAGT GTTTTCAAAAACTTCTCGTGCTTCTTCAAAACTACACTTTTCTT CCATACATTCTCTCTCAAGGTTCCCTTGAACAAA | 2433 |
| | AAGAAGCACGAGAAGTT | 2434 |
| | AACTTCTCGTGCTTCTT | 2435 |
| Haemophilia B Glu30Lys aGAA-AAA | GTTCAAGGGAACCTTGAGAGAGAATGTATGGAAGAAAAGTGT AGTTTTGAAGAAGCACGAGAAGTTTTTGAAAACACTGAAAGAA CAGTGAGTATTTCCACATAATACCCTTCAGATGCAG | 2436 |
| | CTGCATCTGAAGGGTATTATGTGGAAATACTCACTGTTCTTTC AGTGTTTTCAAAAACTTCTCGTGCTTCTTCAAAACTACACTTTT CTTCCATACATTCTCTCTCAAGGTTCCCTTGAAC | 2437 |
| | AAGCACGAGAAGTTTTT | 2438 |
| | AAAAACTTCTCGTGCTT | 2439 |
| Haemophilia B Glu30Term aGAA-TAA | GTTCAAGGGAACCTTGAGAGAGAATGTATGGAAGAAAAGTGT AGTTTTGAAGAAGCACGAGAAGTTTTTGAAAACACTGAAAGAA CAGTGAGTATTTCCACATAATACCCTTCAGATGCAG | 2440 |
| | CTGCATCTGAAGGGTATTATGTGGAAATACTCACTGTTCTTTC AGTGTTTTCAAAAACTTCTCGTGCTTCTTCAAAACTACACTTTT CTTCCATACATTCTCTCTCAAGGTTCCCTTGAAC | 2441 |
| | AAGCACGAGAAGTTTTT | 2442 |
| | AAAAACTTCTCGTGCTT | 2443 |
| Haemophilia B Glu33Asp GAAa-GAC | CCTTGAGAGAGAATGTATGGAAGAAAAGTGTAGTTTTGAAGAA GCACGAGAAGTTTTTGAAAACACTGAAAGAACAGTGAGTATTT CCACATAATACCCTTCAGATGCAGAGCATAGAATA | 2444 |

TABLE 21-continued

Factor IX Mutations and Genome-Correcting Oligos

| Clinical Phenotype & Mutation | Correcting Oligos | SEQ ID NO: |
|---|---|---|
| | TATTCTATGCTCTGCATCTGAAGGGTATTATGTGGAAATACTC ACTGTTCTTTCAGTGTTTTCAAAAACTTCTCGTGCTTCTTCAAA ACTACACTTTTCTTCCATACATTCTCTCTCAAGG | 2445 |
| | GTTTTTGAAAACACTGA | 2446 |
| | TCAGTGTTTTCAAAAAC | 2447 |
| Haemophilia B Glu33Term tGAA-TAA | AACCTTGAGAGAGAATGTATGGAAGAAAAGTGTAGTTTTGAAG AAGCACGAGAAGTTTTTGAAAACACTGAAAGAACAGTGAGTAT TTCCACATAATACCCTTCAGATGCAGAGCATAGAA | 2448 |
| | TTCTATGCTCTGCATCTGAAGGGTATTATGTGGAAATACTCAC TGTTCTTTCAGTGTTTTCAAAAACTTCTCGTGCTTCTTCAAAAC TACACTTTTCTTCCATACATTCTCTCTCAAGGTT | 2449 |
| | AAGTTTTTGAAAACACT | 2450 |
| | AGTGTTTTCAAAAACTT | 2451 |
| Haemophilia B Trp42Term TGG-TAG | CAAAACACTTTAGATATTACCGTTAATTTGTCTTCTTTTATTCTT TATAGACTGAATTTTGGAAGCAGTATGTTGGTAAGCAATTCAT TTTATCCTCTAGCTAATATATGAAACATATGAG | 2452 |
| | CTCATATGTTTCATATATTAGCTAGAGGATAAAATGAATTGCTT ACCAACATACTGCTTCCAAAATTCAGTCTATAAAGAATAAAAG AAGACAAATTAACGGTAATATCTAAAGTGTTTTG | 2453 |
| | TGAATTTTGGAAGCAGT | 2454 |
| | ACTGCTTCCAAAATTCA | 2455 |
| Haemophilia B Lys43Glu gAAG-GAG | AAACACTTTAGATATTACCGTTAATTTGTCTTCTTTTATTCTTTA TAGACTGAATTTTGGAAGCAGTATGTTGGTAAGCAATTCATTT TATCCTCTAGCTAATATATGAAACATATGAGAA | 2456 |
| | TTCTCATATGTTTCATATATTAGCTAGAGGATAAAATGAATTGC TTACCAACATACTGCTTCCAAAATTCAGTCTATAAAGAATAAAA GAAGACAAATTAACGGTAATATCTAAAGTGTTT | 2457 |
| | AATTTTGGAAGCAGTAT | 2458 |
| | ATACTGCTTCCAAAATT | 2459 |
| Haemophilia B Gln44Term gCAG-TAG | CACTTTAGATATTACCGTTAATTTGTCTTCTTTTATTCTTTATAG ACTGAATTTTGGAAGCAGTATGTTGGTAAGCAATTCATTTTATC CTCTAGCTAATATATGAAACATATGAGAATTA | 2460 |
| | TAATTCTCATATGTTTCATATATTAGCTAGAGGATAAAATGAAT TGCTTACCAACATACTGCTTCCAAAATTCAGTCTATAAAGAATA AAGAAGACAAATTAACGGTAATATCTAAAGTG | 2461 |
| | TTTGGAAGCAGTATGTT | 2462 |
| | AACATACTGCTTCCAAA | 2463 |
| Haemophilia B Asp49Gly GAT-GGT | CCGGGCATTCTAAGCAGTTTACGTGCCAATTCAATTTCTTAAC CTATCTCAAAGATGGAGATCAGTGTGAGTCCAATCCATGTTTA AATGGCGGCAGTTGCAAGGATGACATTAATTCCTA | 2464 |
| | TAGGAATTAATGTCATCCTTGCAACTGCCGCCATTTAAACATG GATTGGACTCACACTGATCTCCATCTTTGAGATAGGTTAAGAA ATTGAATTGGCACGTAAACTGCTTAGAATGCCCGG | 2465 |
| | AGATGGAGATCAGTGTG | 2466 |
| | CACACTGATCTCCATCT | 2467 |
| Haemophilia B Gln50His CAGt-CAC | GCATTCTAAGCAGTTTACGTGCCAATTCAATTTCTTAACCTATC TCAAAGATGGAGATCAGTGTGAGTCCAATCCATGTTTAAATGG CGGCAGTTGCAAGGATGACATTAATTCCTATGAA | 2468 |
| | TTCATAGGAATTAATGTCATCCTTGCAACTGCCGCCATTTAAA | 2469 |

TABLE 21-continued

Factor IX Mutations and Genome-Correcting Oligos

| Clinical Phenotype & Mutation | Correcting Oligos | SEQ ID NO: |
|---|---|---|
| | CATGGATTGGACTCACACTGATCTCCATCTTTGAGATAGGTTAAGAAATTGAATTGGCACGTAAACTGCTTAGAATGC | |
| | GGAGATCAGTGTGAGTC | 2470 |
| | GACTCACACTGATCTCC | 2471 |
| Haemophilia B Gln50Pro CAG-CCG | GGCATTCTAAGCAGTTTACGTGCCAATTCAATTTCTTAACCTATCTCAAAGATGGAGATCAGTGTGAGTCCAATCCATGTTTAAATGGCGGCAGTTGCAAGGATGACATTAATTCCTATGA | 2472 |
| | TCATAGGAATTAATGTCATCCTTGCAACTGCCGCCATTTAAACATGGATTGGACTCACACTGATCTCCATCTTTGAGATAGGTTAAGAAATTGAATTGGCACGTAAACTGCTTAGAATGCC | 2473 |
| | TGGAGATCAGTGTGAGT | 2474 |
| | ACTCACACTGATCTCCA | 2475 |
| Haemophilia B Gln50Term tCAG-TAG | GGGCATTCTAAGCAGTTTACGTGCCAATTCAATTTCTTAACCTATCTCAAAGATGGAGATCAGTGTGAGTCCAATCCATGTTTAAATGGCGGCAGTTGCAAGGATGACATTAATTCCTATG | 2476 |
| | CATAGGAATTAATGTCATCCTTGCAACTGCCGCCATTTAAACATGGATTGGACTCACACTGATCTCCATCTTTGAGATAGGTTAAGAAATTGAATTGGCACGTAAACTGCTTAGAATGCCC | 2477 |
| | ATGGAGATCAGTGTGAG | 2478 |
| | CTCACACTGATCTCCAT | 2479 |
| Haemophilia B Cys51Arg gTGT-CGT | CATTCTAAGCAGTTTACGTGCCAATTCAATTTCTTAACCTATCTCAAAGATGGAGATCAGTGTGAGTCCAATCCATGTTTAAATGGCGGCAGTTGCAAGGATGACATTAATTCCTATGAAT | 2480 |
| | ATTCATAGGAATTAATGTCATCCTTGCAACTGCCGCCATTTAAACATGGATTGGACTCACACTGATCTCCATCTTTGAGATAGGTTAAGAAATTGAATTGGCACGTAAACTGCTTAGAATG | 2481 |
| | GAGATCAGTGTGAGTCC | 2482 |
| | GGACTCACACTGATCTC | 2483 |
| Haemophilia B Cys51Ser gTGT-AGT | CATTCTAAGCAGTTTACGTGCCAATTCAATTTCTTAACCTATCTCAAAGATGGAGATCAGTGTGAGTCCAATCCATGTTTAAATGGCGGCAGTTGCAAGGATGACATTAATTCCTATGAAT | 2484 |
| | ATTCATAGGAATTAATGTCATCCTTGCAACTGCCGCCATTTAAACATGGATTGGACTCACACTGATCTCCATCTTTGAGATAGGTTAAGAAATTGAATTGGCACGTAAACTGCTTAGAATG | 2485 |
| | GAGATCAGTGTGAGTCC | 2486 |
| | GGACTCACACTGATCTC | 2487 |
| Haemophilia B Cys51Trp TGTg-TGG | TTCTAAGCAGTTTACGTGCCAATTCAATTTCTTAACCTATCTCAAAGATGGAGATCAGTGTGAGTCCAATCCATGTTTAAATGGCGGCAGTTGCAAGGATGACATTAATTCCTATGAATGT | 2488 |
| | ACATTCATAGGAATTAATGTCATCCTTGCAACTGCCGCCATTTAAACATGGATTGGACTCACACTGATCTCCATCTTTGAGATAGGTTAAGAAATTGAATTGGCACGTAAACTGCTTAGAA | 2489 |
| | GATCAGTGTGAGTCCAA | 2490 |
| | TTGGACTCACACTGATC | 2491 |
| Haemophilia B Glu52Term tGAG-TAG | TCTAAGCAGTTTACGTGCCAATTCAATTTCTTAACCTATCTCAAAGATGGAGATCAGTGTGAGTCCAATCCATGTTTAAATGGCGGCAGTTGCAAGGATGACATTAATTCCTATGAATGTT | 2492 |
| | AACATTCATAGGAATTAATGTCATCCTTGCAACTGCCGCCATTTAAACATGGATTGGACTCACACTGATCTCCATCTTTGAGATAGGTTAAGAAATTGAATTGGCACGTAAACTGCTTAGA | 2493 |

TABLE 21-continued

Factor IX Mutations and Genome-Correcting Oligos

| Clinical Phenotype & Mutation | Correcting Oligos | SEQ ID NO: |
|---|---|---|
| | ATCAGTGTGAGTCCAAT | 2494 |
| | ATTGGACTCACACTGAT | 2495 |
| Haemophilia B Pro55Ala tCCA-GCA | TTTACGTGCCAATTCAATTTCTTAACCTATCTCAAAGATGGAG ATCAGTGTGAGTCCAATCCATGTTTAAATGGCGGCAGTTGCA AGGATGACATTAATTCCTATGAATGTTGGTGTCCCT | 2496 |
| | AGGGACACCAACATTCATAGGAATTAATGTCATCCTTGCAACT GCCGCCATTTAAACATGGATTGGACTCACACTGATCTCCATCT TTGAGATAGGTTAAGAAATTGAATTGGCACGTAAA | 2497 |
| | AGTCCAATCCATGTTTA | 2498 |
| | TAAACATGGATTGGACT | 2499 |
| Haemophilia B Pro55Arg CCA-CGA | TTACGTGCCAATTCAATTTCTTAACCTATCTCAAAGATGGAGA TCAGTGTGAGTCCAATCCATGTTTAAATGGCGGCAGTTGCAA GGATGACATTAATTCCTATGAATGTTGGTGTCCCTT | 2500 |
| | AAGGGACACCAACATTCATAGGAATTAATGTCATCCTTGCAAC TGCCGCCATTTAAACATGGATTGGACTCACACTGATCTCCATC TTTGAGATAGGTTAAGAAATTGAATTGGCACGTAA | 2501 |
| | GTCCAATCCATGTTTAA | 2502 |
| | TTAAACATGGATTGGAC | 2503 |
| Haemophilia B Pro55Gln CCA-CAA | TTACGTGCCAATTCAATTTCTTAACCTATCTCAAAGATGGAGA TCAGTGTGAGTCCAATCCATGTTTAAATGGCGGCAGTTGCAA GGATGACATTAATTCCTATGAATGTTGGTGTCCCTT | 2504 |
| | AAGGGACACCAACATTCATAGGAATTAATGTCATCCTTGCAAC TGCCGCCATTTAAACATGGATTGGACTCACACTGATCTCCATC TTTGAGATAGGTTAAGAAATTGAATTGGCACGTAA | 2505 |
| | GTCCAATCCATGTTTAA | 2506 |
| | TTAAACATGGATTGGAC | 2507 |
| Haemophilia B Pro55Leu CCA-CTA | TTACGTGCCAATTCAATTTCTTAACCTATCTCAAAGATGGAGA TCAGTGTGAGTCCAATCCATGTTTAAATGGCGGCAGTTGCAA GGATGACATTAATTCCTATGAATGTTGGTGTCCCTT | 2508 |
| | AAGGGACACCAACATTCATAGGAATTAATGTCATCCTTGCAAC TGCCGCCATTTAAACATGGATTGGACTCACACTGATCTCCATC TTTGAGATAGGTTAAGAAATTGAATTGGCACGTAA | 2509 |
| | GTCCAATCCATGTTTAA | 2510 |
| | TTAAACATGGATTGGAC | 2511 |
| Haemophilia B Pro55Ser tCCA-TCA | TTTACGTGCCAATTCAATTTCTTAACCTATCTCAAAGATGGAG ATCAGTGTGAGTCCAATCCATGTTTAAATGGCGGCAGTTGCA AGGATGACATTAATTCCTATGAATGTTGGTGTCCCT | 2512 |
| | AGGGACACCAACATTCATAGGAATTAATGTCATCCTTGCAACT GCCGCCATTTAAACATGGATTGGACTCACACTGATCTCCATCT TTGAGATAGGTTAAGAAATTGAATTGGCACGTAAA | 2513 |
| | AGTCCAATCCATGTTTA | 2514 |
| | TAAACATGGATTGGACT | 2515 |
| Haemophilia B Cys56Arg aTGT-CGT | ACGTGCCAATTCAATTTCTTAACCTATCTCAAAGATGGAGATC AGTGTGAGTCCAATCCATGTTTAAATGGCGGCAGTTGCAAGG ATGACATTAATTCCTATGAATGTTGGTGTCCCTTTG | 2516 |
| | CAAAGGGACACCAACATTCATAGGAATTAATGTCATCCTTGCA ACTGCCGCCATTTAAACATGGATTGGACTCACACTGATCTCC ATCTTTGAGATAGGTTAAGAAATTGAATTGGCACGT | 2517 |

TABLE 21-continued

Factor IX Mutations and Genome-Correcting Oligos

| Clinical Phenotype & Mutation | Correcting Oligos | SEQ ID NO: |
|---|---|---|
| | CCAATCCATGTTTAAAT | 2518 |
| | ATTTAAACATGGATTGG | 2519 |
| Haemophilia B Cys56Ser aTGT-AGT | ACGTGCCAATTCAATTTCTTAACCTATCTCAAAGATGGAGATC AGTGTGAGTCCAATCCATGTTTAAATGGCGGCAGTTGCAAGG ATGACATTAATTCCTATGAATGTTGGTGTCCCTTTG | 2520 |
| | CAAAGGGACACCAACATTCATAGGAATTAATGTCATCCTTGCA ACTGCCGCCATTTAAACATGGATTGGACTCACACTGATCTCC ATCTTTGAGATAGGTTAAGAAATTGAATTGGCACGT | 2521 |
| | CCAATCCATGTTTAAAT | 2522 |
| | ATTTAAACATGGATTGG | 2523 |
| Haemophilia B Cys56Ser TGT-TCT | CGTGCCAATTCAATTTCTTAACCTATCTCAAAGATGGAGATCA GTGTGAGTCCAATCCATGTTTAAATGGCGGCAGTTGCAAGGA TGACATTAATTCCTATGAATGTTGGTGTCCCTTTGG | 2524 |
| | CCAAAGGGACACCAACATTCATAGGAATTAATGTCATCCTTGC AACTGCCGCCATTTAAACATGGATTGGACTCACACTGATCTCC ATCTTTGAGATAGGTTAAGAAATTGAATTGGCACG | 2525 |
| | CAATCCATGTTTAAATG | 2526 |
| | CATTTAAACATGGATTG | 2527 |
| Haemophilia B Cys56Tyr TGT-TAT | CGTGCCAATTCAATTTCTTAACCTATCTCAAAGATGGAGATCA GTGTGAGTCCAATCCATGTTTAAATGGCGGCAGTTGCAAGGA TGACATTAATTCCTATGAATGTTGGTGTCCCTTTGG | 2528 |
| | CCAAAGGGACACCAACATTCATAGGAATTAATGTCATCCTTGC AACTGCCGCCATTTAAACATGGATTGGACTCACACTGATCTCC ATCTTTGAGATAGGTTAAGAAATTGAATTGGCACG | 2529 |
| | CAATCCATGTTTAAATG | 2530 |
| | CATTTAAACATGGATTG | 2531 |
| Haemophilia B Asn58Lys AATg-AAG | ATTCAATTTCTTAACCTATCTCAAAGATGGAGATCAGTGTGAG TCCAATCCATGTTTAAATGGCGGCAGTTGCAAGGATGACATTA ATTCCTATGAATGTTGGTGTCCCTTGGATTTGAA | 2532 |
| | TTCAAATCCAAAGGGACACCAACATTCATAGGAATTAATGTCA TCCTTGCAACTGCCGCCATTTAAACATGGATTGGACTCACACT GATCTCCATCTTTGAGATAGGTTAAGAAATTGAAT | 2533 |
| | TGTTTAAATGGCGGCAG | 2534 |
| | CTGCCGCCATTTAAACA | 2535 |
| Haemophilia B Gly59Asp GGC-GAC | TCAATTTCTTAACCTATCTCAAAGATGGAGATCAGTGTGAGTC CAATCCATGTTTAAATGGCGGCAGTTGCAAGGATGACATTAAT TCCTATGAATGTTGGTGTCCCTTTGGATTTGAAGG | 2536 |
| | CCTTCAAATCCAAAGGGACACCAACATTCATAGGAATTAATGT CATCCTTGCAACTGCCGCCATTTAAACATGGATTGGACTCACA CTGATCTCCATCTTTGAGATAGGTTAAGAAATTGA | 2537 |
| | TTTAAATGGCGGCAGTT | 2538 |
| | AACTGCCGCCATTTAAA | 2539 |
| Haemophilia B Gly59Val GGC-GTC | TCAATTTCTTAACCTATCTCAAAGATGGAGATCAGTGTGAGTC CAATCCATGTTTAAATGGCGGCAGTTGCAAGGATGACATTAAT TCCTATGAATGTTGGTGTCCCTTTGGATTTGAAGG | 2540 |
| | CCTTCAAATCCAAAGGGACACCAACATTCATAGGAATTAATGT CATCCTTGCAACTGCCGCCATTTAAACATGGATTGGACTCACA CTGATCTCCATCTTTGAGATAGGTTAAGAAATTGA | 2541 |

TABLE 21-continued

Factor IX Mutations and Genome-Correcting Oligos

| Clinical Phenotype & Mutation | Correcting Oligos | SEQ ID NO: |
|---|---|---|
| | TTTAAATGGCGGCAGTT | 2542 |
| | AACTGCCGCCATTTAAA | 2543 |
| Haemophilia B Gly59Ser tGGC-AGC | TTCAATTTCTTAACCTATCTCAAAGATGGAGATCAGTGTGAGT CCAATCCATGTTTAAATGGCGGCAGTTGCAAGGATGACATTAA TTCCTATGAATGTTGGTGTCCCTTTGGATTTGAAG | 2544 |
| | CTTCAAATCCAAAGGGACACCAACATTCATAGGAATTAATGTC ATCCTTGCAACTGCCGCCATTTAAACATGGATTGGACTCACAC TGATCTCCATCTTTGAGATAGGTTAAGAAATTGAA | 2545 |
| | GTTTAAATGGCGGCAGT | 2546 |
| | ACTGCCGCCATTTAAAC | 2547 |
| Haemophilia B Gly60Ser cGGC-AGC | AATTTCTTAACCTATCTCAAAGATGGAGATCAGTGTGAGTCCA ATCCATGTTTAAATGGCGGCAGTTGCAAGGATGACATTAATTC CTATGAATGTTGGTGTCCCTTTGGATTTGAAGGAA | 2548 |
| | TTCCTTCAAATCCAAAGGGACACCAACATTCATAGGAATTAAT GTCATCCTTGCAACTGCCGCCATTTAAACATGGATTGGACTCA CACTGATCTCCATCTTTGAGATAGGTTAAGAAATT | 2549 |
| | TAAATGGCGGCAGTTGC | 2550 |
| | GCAACTGCCGCCATTTA | 2551 |
| Haemophilia B Gly60Cys cGGC-TGC | AATTTCTTAACCTATCTCAAAGATGGAGATCAGTGTGAGTCCA ATCCATGTTTAAATGGCGGCAGTTGCAAGGATGACATTAATTC CTATGAATGTTGGTGTCCCTTTGGATTGAAGGAA | 2552 |
| | TTCCTTCAAATCCAAAGGGACACCAACATTCATAGGAATTAAT GTCATCCTTGCAACTGCCGCCATTTAAACATGGATTGGACTCA CACTGATCTCCATCTTTGAGATAGGTTAAGAAATT | 2553 |
| | TAAATGGCGGCAGTTGC | 2554 |
| | GCAACTGCCGCCATTTA | 2555 |
| Haemophilia B Gly60Asp GGC-GAC | ATTTCTTAACCTATCTCAAAGATGGAGATCAGTGTGAGTCCAA TCCATGTTTAAATGGCGGCAGTTGCAAGGATGACATTAATTCC TATGAATGTTGGTGTCCCTTTGGATTTGAAGGAAA | 2556 |
| | TTTCCTTCAAATCCAAAGGGACACCAACATTCATAGGAATTAA TGTCATCCTTGCAACTGCCGCCATTTAAACATGGATTGGACTC ACACTGATCTCCATCTTTGAGATAGGTTAAGAAAT | 2557 |
| | AAATGGCGGCAGTTGCA | 2558 |
| | TGCAACTGCCGCCATTT | 2559 |
| Haemophilia B Gly60Arg cGGC-CGC | AATTTCTTAACCTATCTCAAAGATGGAGATCAGTGTGAGTCCA ATCCATGTTTAAATGGCGGCAGTTGCAAGGATGACATTAATTC CTATGAATGTTGGTGTCCCTTTGGATTTGAAGGAA | 2560 |
| | TTCCTTCAAATCCAAAGGGACACCAACATTCATAGGAATTAAT GTCATCCTTGCAACTGCCGCCATTTAAACATGGATTGGACTCA CACTGATCTCCATCTTTGAGATAGGTTAAGAAATT | 2561 |
| | TAAATGGCGGCAGTTGC | 2562 |
| | GCAACTGCCGCCATTTA | 2563 |
| Haemophilia B Cys62Tyr TGC-TAC | TAACCTATCTCAAAGATGGAGATCAGTGTGAGTCCAATCCATG TTTAAATGGCGGCAGTTGCAAGGATGACATTAATTCCTATGAA TGTTGGTGTCCCTTTGGATTTGAAGGAAAGAACTG | 2564 |
| | CAGTTCTTTCCTTCAAATCCAAAGGGACACCAACATTCATAGG AATTAATGTCATCCTTGCAACTGCCGCCATTTAAACATGGATT GGACTCACACTGATCTCCATCTTTGAGATAGGTTA | 2565 |

TABLE 21-continued

Factor IX Mutations and Genome-Correcting Oligos

| Clinical Phenotype & Mutation | Correcting Oligos | SEQ ID NO: |
|---|---|---|
| | CGGCAGTTGCAAGGATG | 2566 |
| | CATCCTTGCAACTGCCG | 2567 |
| Haemophilia B Cys62Ser TGC-TCC | TAACCTATCTCAAAGATGGAGATCAGTGTGAGTCCAATCCATG TTTAAATGGCGGCAGTTGCAAGGATGACATTAATTCCTATGAA TGTTGGTGTCCCTTTGGATTTGAAGGAAAGAACTG | 2568 |
| | CAGTTCTTTCCTTCAAATCCAAAGGGACACCAACATTCATAGG AATTAATGTCATCCTTGCAACTGCCGCCATTTAAACATGGATT GGACTCACACTGATCTCCATCTTTGAGATAGGTTA | 2569 |
| | CGGCAGTTGCAAGGATG | 2570 |
| | CATCCTTGCAACTGCCG | 2571 |
| Haemophilia B Cys62Term TGCa-TGA | AACCTATCTCAAAGATGGAGATCAGTGTGAGTCCAATCCATGT TTAAATGGCGGCAGTTGCAAGGATGACATTAATTCCTATGAAT GTTGGTGTCCCTTTGGATTTGAAGGAAAGAACTGT | 2572 |
| | ACAGTTCTTTCCTTCAAATCCAAAGGGACACCAACATTCATAG GAATTAATGTCATCCTTGCAACTGCCGCCATTTAAACATGGAT TGGACTCACACTGATCTCCATCTTTGAGATAGGTT | 2573 |
| | GGCAGTTGCAAGGATGA | 2574 |
| | TCATCCTTGCAACTGCC | 2575 |
| Haemophilia B Asp64Glu GATg-GAG | TCTCAAAGATGGAGATCAGTGTGAGTCCAATCCATGTTTAAAT GGCGGCAGTTGCAAGGATGACATTAATTCCTATGAATGTTGG TGTCCCTTTGGATTTGAAGGAAAGAACTGTGAATTA | 2576 |
| | TAATTCACAGTTCTTTCCTTCAAATCCAAAGGGACACCAACAT TCATAGGAATTAATGTCATCCTTGCAACTGCCGCCATTTAAAC ATGGATTGGACTCACACTGATCTCCATCTTTGAGA | 2577 |
| | TGCAAGGATGACATTAA | 2578 |
| | TTAATGTCATCCTTGCA | 2579 |
| Haemophilia B Asp64Gly GAT-GGT | ATCTCAAAGATGGAGATCAGTGTGAGTCCAATCCATGTTTAAA TGGCGGCAGTTGCAAGGATGACATTAATTCCTATGAATGTTG GTGTCCCTTTGGATTTGAAGGAAAGAACTGTGAATT | 2580 |
| | AATTCACAGTTCTTTCCTTCAAATCCAAAGGGACACCAACATT CATAGGAATTAATGTCATCCTTGCAACTGCCGCCATTTAAACA TGGATTGGACTCACACTGATCTCCATCTTTGAGAT | 2581 |
| | TTGCAAGGATGACATTA | 2582 |
| | TAATGTCATCCTTGCAA | 2583 |
| Haemophilia B Asp64Asn gGAT-AAT | TATCTCAAAGATGGAGATCAGTGTGAGTCCAATCCATGTTTAA ATGGCGGCAGTTGCAAGGATGACATTAATTCCTATGAATGTTG GTGTCCCTTTGGATTTGAAGGAAAGAACTGTGAAT | 2584 |
| | ATTCACAGTTCTTTCCTTCAAATCCAAAGGGACACCAACATTC ATAGGAATTAATGTCATCCTTGCAACTGCCGCCATTTAAACAT GGATTGGACTCACACTGATCTCCATCTTTGAGATA | 2585 |
| | GTTGCAAGGATGACATT | 2586 |
| | AATGTCATCCTTGCAAC | 2587 |
| Haemophilia B Ile66Ser ATT-AGT | AAGATGGAGATCAGTGTGAGTCCAATCCATGTTTAAATGGCG GCAGTTGCAAGGATGACATTAATTCCTATGAATGTTGGTGTCC CTTTGGATTTGAAGGAAAGAACTGTGAATTAGGTAA | 2588 |
| | TTACCTAATTCACAGTTCTTTCCTTCAAATCCAAAGGGACACC AACATTCATAGGAATTAATGTCATCCTTGCAACTGCCGCCATT TAAACATGGATTGGACTCACACTGATCTCCATCTT | 2589 |

TABLE 21-continued

Factor IX Mutations and Genome-Correcting Oligos

| Clinical Phenotype & Mutation | Correcting Oligos | SEQ ID NO: |
|---|---|---|
| | GGATGACATTAATTCCT | 2590 |
| | AGGAATTAATGTCATCC | 2591 |
| Haemophilia B Ile66Thr ATT-ACT | AAGATGGAGATCAGTGTGAGTCCAATCCATGTTTAAATGGCG GCAGTTGCAAGGATGACATTAATTCCTATGAATGTTGGTGTCC CTTTGGATTTGAAGGAAAGAACTGTGAATTAGGTAA | 2592 |
| | TTACCTAATTCACAGTTCTTTCCTTCAAATCCAAAGGGACACC AACATTCATAGGAATTAATGTCATCCTTGCAACTGCCGCCATT TAAACATGGATTGGACTCACACTGATCTCCATCTT | 2593 |
| | GGATGACATTAATTCCT | 2594 |
| | AGGAATTAATGTCATCC | 2595 |
| Haemophilia B Asn67Lys AATt-AAA | TGGAGATCAGTGTGAGTCCAATCCATGTTTAAATGGCGGCAG TTGCAAGGATGACATTAATTCCTATGAATGTTGGTGTCCCTTT GGATTTGAAGGAAAGAACTGTGAATTAGGTAAGTAA | 2596 |
| | TTACTTACCTAATTCACAGTTCTTTCCTTCAAATCCAAAGGGAC ACCAACATTCATAGGAATTAATGTCATCCTTGCAACTGCCGCC ATTTAAACATGGATTGGACTCACACTGATCTCCA | 2597 |
| | GACATTAATTCCTATGA | 2598 |
| | TCATAGGAATTAATGTC | 2599 |
| Haemophilia B Tyr69Cys TAT-TGT | ATCAGTGTGAGTCCAATCCATGTTTAAATGGCGGCAGTTGCA AGGATGACATTAATTCCTATGAATGTTGGTGTCCCTTTGGATT TGAAGGAAAGAACTGTGAATTAGGTAAGTAACTATT | 2600 |
| | AATAGTTACTTACCTAATTCACAGTTCTTTCCTTCAAATCCAAA GGGACACCAACATTCATAGGAATTAATGTCATCCTTGCAACTG CCGCCATTTAAACATGGATTGGACTCACACTGAT | 2601 |
| | TAATTCCTATGAATGTT | 2602 |
| | AACATTCATAGGAATTA | 2603 |
| Haemophilia B Cys71Term TGTt-TGA | TGAGTCCAATCCATGTTTAAATGGCGGCAGTTGCAAGGATGA CATTAATTCCTATGAATGTTGGTGTCCCTTTGGATTTGAAGGA AAGAACTGTGAATTAGGTAAGTAACTATTTTTTGAA | 2604 |
| | TTCAAAAAATAGTTACTTACCTAATTCACAGTTCTTTCCTTCAA ATCCAAAGGGACACCAACATTCATAGGAATTAATGTCATCCTT GCAACTGCCGCCATTTAAACATGGATTGGACTCA | 2605 |
| | TATGAATGTTGGTGTCC | 2606 |
| | GGACACCAACATTCATA | 2607 |
| Haemophilia B Cys71Ser TGT-TCT | GTGAGTCCAATCCATGTTTAAATGGCGGCAGTTGCAAGGATG ACATTAATTCCTATGAATGTTGGTGTCCCTTTGGATTTGAAGG AAAGAACTGTGAATTAGGTAAGTAACTATTTTTTGA | 2608 |
| | TCAAAAAATAGTTACTTACCTAATTCACAGTTCTTTCCTTCAAA TCCAAAGGGACACCAACATTCATAGGAATTAATGTCATCCTTG CAACTGCCGCCATTTAAACATGGATTGGACTCAC | 2609 |
| | CTATGAATGTTGGTGTC | 2610 |
| | GACACCAACATTCATAG | 2611 |
| Haemophilia B Cys71Tyr TGT-TAT | GTGAGTCCAATCCATGTTTAAATGGCGGCAGTTGCAAGGATG ACATTAATTCCTATGAATGTTGGTGTCCCTTTGGATTTGAAGG AAAGAACTGTGAATTAGGTAAGTAACTATTTTTTGA | 2612 |
| | TCAAAAAATAGTTACTTACCTAATTCACAGTTCTTTCCTTCAAA TCCAAAGGGACACCAACATTCATAGGAATTAATGTCATCCTTG CAACTGCCGCCATTTAAACATGGATTGGACTCAC | 2613 |
| | CTATGAATGTTGGTGTC | 2614 |
| | GACACCAACATTCATAG | 2615 |

TABLE 21-continued

Factor IX Mutations and Genome-Correcting Oligos

| Clinical Phenotype & Mutation | Correcting Oligos | SEQ ID NO: |
|---|---|---|
| Haemophilia B Cys71Ser aTGT-AGT | TGTGAGTCCAATCCATGTTTAAATGGCGGCAGTTGCAAGGAT GACATTAATTCCTATGAATGTTGGTGTCCCTTTGGATTTGAAG GAAAGAACTGTGAATTAGGTAAGTAACTATTTTTTG | 2616 |
| | CAAAAAATAGTTACTTACCTAATTCACAGTTCTTTCCTTCAAAT CCAAAGGGACACCAACATTCATAGGAATTAATGTCATCCTTGC AACTGCCGCCATTTAAACATGGATTGGACTCACA | 2617 |
| | CCTATGAATGTTGGTGT | 2618 |
| | ACACCAACATTCATAGG | 2619 |
| Haemophilia B Trp72Arg tTGG-AGG | GAGTCCAATCCATGTTTAAATGGCGGCAGTTGCAAGGATGAC ATTAATTCCTATGAATGTTGGTGTCCCTTTGGATTTGAAGGAA AGAACTGTGAATTAGGTAAGTAACTATTTTTTGAAT | 2620 |
| | ATTCAAAAAATAGTTACTTACCTAATTCACAGTTCTTTCCTTCA AATCCAAAGGGACACCAACATTCATAGGAATTAATGTCATCCT TGCAACTGCCGCCATTTAAACATGGATTGGACTC | 2621 |
| | ATGAATGTTGGTGTCCC | 2622 |
| | GGGACACCAACATTCAT | 2623 |
| Haemophilia B Trp72Term TGGt-TGA | GTCCAATCCATGTTTAAATGGCGGCAGTTGCAAGGATGACAT TAATTCCTATGAATGTTGGTGTCCCTTTGGATTTGAAGGAAAG AACTGTGAATTAGGTAAGTAACTATTTTTTGAATAC | 2624 |
| | GTATTCAAAAAATAGTTACTTACCTAATTCACAGTTCTTTCCTT CAAATCCAAAGGGACACCAACATTCATAGGAATTAATGTCATC CTTGCAACTGCCGCCATTTAAACATGGATTGGAC | 2625 |
| | GAATGTTGGTGTCCCTT | 2626 |
| | AAGGGACACCAACATTC | 2627 |
| Haemophilia B Cys73Tyr TGT-TAT | CCAATCCATGTTTAAATGGCGGCAGTTGCAAGGATGACATTAA TTCCTATGAATGTTGGTGTCCCTTTGGATTTGAAGGAAAGAAC TGTGAATTAGGTAAGTAACTATTTTTTGAATACTC | 2628 |
| | GAGTATTCAAAAAATAGTTACTTACCTAATTCACAGTTCTTTCC TTCAAATCCAAAGGGACACCAACATTCATAGGAATTAATGTCA TCCTTGCAACTGCCGCCATTTAAACATGGATTGG | 2629 |
| | ATGTTGGTGTCCCTTTG | 2630 |
| | CAAAGGGACACCAACAT | 2631 |
| Haemophilia B Cys73Arg gTGT-CGT | TCCAATCCATGTTTAAATGGCGGCAGTTGCAAGGATGACATTA ATTCCTATGAATGTTGGTGTCCCTTTGGATTTGAAGGAAAGAA CTGTGAATTAGGTAAGTAACTATTTTTTGAATACT | 2632 |
| | AGTATTCAAAAAATAGTTACTTACCTAATTCACAGTTCTTTCCT TCAAATCCAAAGGGACACCAACATTCATAGGAATTAATGTCAT CCTTGCAACTGCCGCCATTTAAACATGGATTGGA | 2633 |
| | AATGTTGGTGTCCCTTT | 2634 |
| | AAAGGGACACCAACATT | 2635 |
| Haemophilia B Cys73Phe TGT-TTT | CCAATCCATGTTTAAATGGCGGCAGTTGCAAGGATGACATTAA TTCCTATGAATGTTGGTGTCCCTTTGGATTTGAAGGAAAGAAC TGTGAATTAGGTAAGTAACTATTTTTTGAATACTC | 2636 |
| | GAGTATTCAAAAAATAGTTACTTACCTAATTCACAGTTCTTTCC TTCAAATCCAAAGGGACACCAACATTCATAGGAATTAATGTCA TCCTTGCAACTGCCGCCATTTAAACATGGATTGG | 2637 |
| | ATGTTGGTGTCCCTTTG | 2638 |
| | CAAAGGGACACCAACAT | 2639 |
| Haemophilia B | CAATCCATGTTTAAATGGCGGCAGTTGCAAGGATGACATTAAT | 2640 |

TABLE 21-continued

Factor IX Mutations and Genome-Correcting Oligos

| Clinical Phenotype & Mutation | Correcting Oligos | SEQ ID NO: |
|---|---|---|
| Cys73Term<br>TGTc-TGA | TCCTATGAATGTTGGTGTCCCTTTGGATTTGAAGGAAAGAACT<br>GTGAATTAGGTAAGTAACTATTTTTTGAATACTCA | |
| | TGAGTATTCAAAAAATAGTTACTTACCTAATTCACAGTTCTTTC<br>CTTCAAATCCAAAGGGACACCAACATTCATAGGAATTAATGTC<br>ATCCTTGCAACTGCCGCCATTTAAACATGGATTG | 2641 |
| | TGTTGGTGTCCCTTTGG | 2642 |
| | CCAAAGGGACACCAACA | 2643 |
| Haemophilia B<br>Gly76Val<br>GGA-GTA | GTTTAAATGGCGGCAGTTGCAAGGATGACATTAATTCCTATGA<br>ATGTTGGTGTCCCTTTGGATTTGAAGGAAAGAACTGTGAATTA<br>GGTAAGTAACTATTTTTTGAATACTCATGGTTCAA | 2644 |
| | TTGAACCATGAGTATTCAAAAAATAGTTACTTACCTAATTCACA<br>GTTCTTTCCTTCAAATCCAAAGGGACACCAACATTCATAGGAA<br>TTAATGTCATCCTTGCAACTGCCGCCATTTAAAC | 2645 |
| | TCCCTTTGGATTTGAAG | 2646 |
| | CTTCAAATCCAAAGGGA | 2647 |
| Haemophilia B<br>Gly76Arg<br>tGGA-AGA | TGTTTAAATGGCGGCAGTTGCAAGGATGACATTAATTCCTATG<br>AATGTTGGTGTCCCTTTGGATTTGAAGGAAAGAACTGTGAATT<br>AGGTAAGTAACTATTTTTTGAATACTCATGGTTCA | 2648 |
| | TGAACCATGAGTATTCAAAAAATAGTTACTTACCTAATTCACAG<br>TTCTTTCCTTCAAATCCAAAGGGACACCAACATTCATAGGAAT<br>TAATGTCATCCTTGCAACTGCCGCCATTTAAACA | 2649 |
| | GTCCCTTTGGATTTGAA | 2650 |
| | TTCAAATCCAAAGGGAC | 2651 |
| Haemophilia B<br>Phe77Cys<br>TTT-TGT | TAAATGGCGGCAGTTGCAAGGATGACATTAATTCCTATGAATG<br>TTGGTGTCCCTTTGGATTTGAAGGAAAGAACTGTGAATTAGGT<br>AAGTAACTATTTTTTGAATACTCATGGTTCAAAGT | 2652 |
| | ACTTTGAACCATGAGTATTCAAAAAATAGTTACTTACCTAATTC<br>ACAGTTCTTTCCTTCAAATCCAAAGGGACACCAACATTCATAG<br>GAATTAATGTCATCCTTGCAACTGCCGCCATTTA | 2653 |
| | CTTTGGATTTGAAGGAA | 2654 |
| | TTCCTTCAAATCCAAAG | 2655 |
| Haemophilia B<br>Phe77Ser<br>TTT-TCT | TAAATGGCGGCAGTTGCAAGGATGACATTAATTCCTATGAATG<br>TTGGTGTCCCTTTGGATTTGAAGGAAAGAACTGTGAATTAGGT<br>AAGTAACTATTTTTTGAATACTCATGGTTCAAAGT | 2656 |
| | ACTTTGAACCATGAGTATTCAAAAAATAGTTACTTACCTAATTC<br>ACAGTTCTTTCCTTCAAATCCAAAGGGACACCAACATTCATAG<br>GAATTAATGTCATCCTTGCAACTGCCGCCATTTA | 2657 |
| | CTTTGGATTTGAAGGAA | 2658 |
| | TTCCTTCAAATCCAAAG | 2659 |
| Haemophilia B<br>Phe77Tyr<br>TTT-TAT | TAAATGGCGGCAGTTGCAAGGATGACATTAATTCCTATGAATG<br>TTGGTGTCCCTTTGGATTTGAAGGAAAGAACTGTGAATTAGGT<br>AAGTAACTATTTTTTGAATACTCATGGTTCAAAGT | 2660 |
| | ACTTTGAACCATGAGTATTCAAAAAATAGTTACTTACCTAATTC<br>ACAGTTCTTTCCTTCAAATCCAAAGGGACACCAACATTCATAG<br>GAATTAATGTCATCCTTGCAACTGCCGCCATTTA | 2661 |
| | CTTTGGATTTGAAGGAA | 2662 |
| | TTCCTTCAAATCCAAAG | 2663 |
| Haemophilia B<br>Glu78Lys<br>tGAA-AAA | AATGGCGGCAGTTGCAAGGATGACATTAATTCCTATGAATGTT<br>GGTGTCCCTTTGGATTTGAAGGAAAGAACTGTGAATTAGGTAA<br>GTAACTATTTTTTGAATACTCATGGTTCAAAGTTT | 2664 |

TABLE 21-continued

Factor IX Mutations and Genome-Correcting Oligos

| Clinical Phenotype & Mutation | Correcting Oligos | SEQ ID NO: |
|---|---|---|
| | AAACTTTGAACCATGAGTATTCAAAAAATAGTTACTTACCTAAT TCACAGTTCTTTCCTTCAAATCCAAAGGGACACCAACATTCAT AGGAATTAATGTCATCCTTGCAACTGCCGCCATT | 2665 |
| | TTGGATTTGAAGGAAAG | 2666 |
| | CTTTCCTTCAAATCCAA | 2667 |
| Haemophilia B Gly79Val GGA-GTA | GCGGCAGTTGCAAGGATGACATTAATTCCTATGAATGTTGGT GTCCCTTTGGATTTGAAGGAAAGAACTGTGAATTAGGTAAGTA ACTATTTTTTGAATACTCATGGTTCAAAGTTTCCCT | 2668 |
| | AGGGAAACTTTGAACCATGAGTATTCAAAAAATAGTTACTTAC CTAATTCACAGTTCTTTCCTTCAAATCCAAAGGGACACCAACA TTCATAGGAATTAATGTCATCCTTGCAACTGCCGC | 2669 |
| | ATTTGAAGGAAAGAACT | 2670 |
| | AGTTCTTTCCTTCAAAT | 2671 |
| Haemophilia B Gly79Arg aGGA-AGA | GGCGGCAGTTGCAAGGATGACATTAATTCCTATGAATGTTGG TGTCCCTTTGGATTTGAAGGAAAGAACTGTGAATTAGGTAAGT AACTATTTTTTGAATACTCATGGTTCAAAGTTTCCC | 2672 |
| | GGGAAACTTTGAACCATGAGTATTCAAAAAATAGTTACTTACC TAATTCACAGTTCTTTCCTTCAAATCCAAAGGGACACCAACAT TCATAGGAATTAATGTCATCCTTGCAACTGCCGCC | 2673 |
| | GATTTGAAGGAAAGAAC | 2674 |
| | GTTCTTTCCTTCAAATC | 2675 |
| Haemophilia B Gly79Glu GGA-GAA | GCGGCAGTTGCAAGGATGACATTAATTCCTATGAATGTTGGT GTCCCTTTGGATTTGAAGGAAAGAACTGTGAATTAGGTAAGTA ACTATTTTTTGAATACTCATGGTTCAAAGTTTCCCT | 2676 |
| | AGGGAAACTTTGAACCATGAGTATTCAAAAAATAGTTACTTAC CTAATTCACAGTTCTTTCCTTCAAATCCAAAGGGACACCAACA TTCATAGGAATTAATGTCATCCTTGCAACTGCCGC | 2677 |
| | ATTTGAAGGAAAGAACT | 2678 |
| | AGTTCTTTCCTTCAAAT | 2679 |
| Haemophilia B Cys88Ser TGT-TCT | TTAGAAATGCATGTTAAATGATGCTGTTACTGTCTATTTTGCTT CTTTTAGATGTAACATGTAACATTAAGAATGGCAGATGCGAGC AGTTTTGTAAAAATAGTGCTGATAACAAGGTGGT | 2680 |
| | ACCACCTTGTTATCAGCACTATTTTTACAAAACTGCTCGCATC TGCCATTCTTAATGTTACATGTTACATCTAAAAGAAGCAAAATA GACAGTAACAGCATCATTTAACATGCATTTCTAA | 2681 |
| | TGTAACATGTAACATTA | 2682 |
| | TAATGTTACATGTTACA | 2683 |
| Haemophilia B Cys88Phe TGT-TTT | TTAGAAATGCATGTTAAATGATGCTGTTACTGTCTATTTTGCTT CTTTTAGATGTAACATGTAACATTAAGAATGGCAGATGCGAGC AGTTTTGTAAAAATAGTGCTGATAACAAGGTGGT | 2684 |
| | ACCACCTTGTTATCAGCACTATTTTTACAAAACTGCTCGCATC TGCCATTCTTAATGTTACATGTTACATCTAAAAGAAGCAAAATA GACAGTAACAGCATCATTTAACATGCATTTCTAA | 2685 |
| | TGTAACATGTAACATTA | 2686 |
| | TAATGTTACATGTTACA | 2687 |
| Haemophilia B Cys88Arg aTGT-CGT | TTTAGAAATGCATGTTAAATGATGCTGTTACTGTCTATTTTGCT TCTTTTAGATGTAACATGTAACATTAAGAATGGCAGATGCGAG CAGTTTTGTAAAAATAGTGCTGATAACAAGGTGG | 2688 |
| | CCACCTTGTTATCAGCACTATTTTTACAAAACTGCTCGCATCT | 2689 |

TABLE 21-continued

Factor IX Mutations and Genome-Correcting Oligos

| Clinical Phenotype & Mutation | Correcting Oligos | SEQ ID NO: |
|---|---|---|
| | GCCATTCTTAATGTTACATGTTACATCTAAAAGAAGCAAAATA GACAGTAACAGCATCATTTAACATGCATTTCTAAA | |
| | ATGTAACATGTAACATT | 2690 |
| | AATGTTACATGTTACAT | 2691 |
| Haemophilia B Cys88Tyr TGT-TAT | TTAGAAATGCATGTTAAATGATGCTGTTACTGTCTATTTTGCTT CTTTTAGATGTAACATGTAACATTAAGAATGGCAGATGCGAGC AGTTTTGTAAAAATAGTGCTGATAACAAGGTGGT | 2692 |
| | ACCACCTTGTTATCAGCACTATTTTTACAAAACTGCTCGCATC TGCCATTCTTAATGTTACATGTTACATCTAAAAGAAGCAAAATA GACAGTAACAGCATCATTTAACATGCATTTCTAA | 2693 |
| | TGTAACATGTAACATTA | 2694 |
| | TAATGTTACATGTTACA | 2695 |
| Haemophilia B Ile90Thr ATT-ACT | ATGCATGTTAAATGATGCTGTTACTGTCTATTTTGCTTCTTTTA GATGTAACATGTAACATTAAGAATGGCAGATGCGAGCAGTTTT GTAAAAATAGTGCTGATAACAAGGTGGTTTGCTC | 2696 |
| | GAGCAAACCACCTTGTTATCAGCACTATTTTTACAAAACTGCT CGCATCTGCCATTCTTAATGTTACATGTTACATCTAAAAGAAG CAAAATAGACAGTAACAGCATCATTTAACATGCAT | 2697 |
| | ATGTAACATTAAGAATG | 2698 |
| | CATTCTTAATGTTACAT | 2699 |
| Haemophilia B Asn92His gAAT-CAT | TGTTAAATGATGCTGTTACTGTCTATTTTGCTTCTTTTAGATGT AACATGTAACATTAAGAATGGCAGATGCGAGCAGTTTTGTAAA AATAGTGCTGATAACAAGGTGGTTTGCTCCTGTA | 2700 |
| | TACAGGAGCAAACCACCTTGTTATCAGCACTATTTTTACAAAA CTGCTCGCATCTGCCATTTCTTAATGTTACATGTTACATCTAAAA GAAGCAAAATAGACAGTAACAGCATCATTTAACA | 2701 |
| | ACATTAAGAATGGCAGA | 2702 |
| | TCTGCCATTTCTTAATGT | 2703 |
| Haemophilia B Asn92Lys AATg-AAA | TTAAATGATGCTGTTACTGTCTATTTTGCTTCTTTTAGATGTAA CATGTAACATTAAGAATGGCAGATGCGAGCAGTTTTGTAAAAA TAGTGCTGATAACAAGGTGGTTTGCTCCTGTACT | 2704 |
| | AGTACAGGAGCAAACCACCTTGTTATCAGCACTATTTTTACAA AACTGCTCGCATCTGCCATTCTTAATGTTACATGTTACATCTA AAAGAAGCAAAATAGACAGTAACAGCATCATTTAA | 2705 |
| | ATTAAGAATGGCAGATG | 2706 |
| | CATCTGCCATTCTTAAT | 2707 |
| Haemophilia B Gly93Asp GGC-GAC | AAATGATGCTGTTACTGTCTATTTTGCTTCTTTTAGATGTAACA TGTAACATTAAGAATGGCAGATGCGAGCAGTTTTGTAAAAATA GTGCTGATAACAAGGTGGTTTGCTCCTGTACTGA | 2708 |
| | TCAGTACAGGAGCAAACCACCTTGTTATCAGCACTATTTTTAC AAAACTGCTCGCATCTGCCATTCTTAATGTTACATGTTACATCT AAAAGAAGCAAAATAGACAGTAACAGCATCATTT | 2709 |
| | TAAGAATGGCAGATGCG | 2710 |
| | CGCATCTGCCATTCTTA | 2711 |
| Haemophilia B Gly93Ser tGGC-AGC | TAAATGATGCTGTTACTGTCTATTTTGCTTCTTTTAGATGTAAC ATGTAACATTAAGAATGGCAGATGCGAGCAGTTTTGTAAAAAT AGTGCTGATAACAAGGTGGTTTGCTCCTGTACTG | 2712 |
| | CAGTACAGGAGCAAACCACCTTGTTATCAGCACTATTTTTACA AAACTGCTCGCATCTGCCATTCTTAATGTTACATGTTACATCTA AAAGAAGCAAAATAGACAGTAACAGCATCATTTA | 2713 |

TABLE 21-continued

Factor IX Mutations and Genome-Correcting Oligos

| Clinical Phenotype & Mutation | Correcting Oligos | SEQ ID NO: |
|---|---|---|
| | TTAAGAATGGCAGATGC | 2714 |
| | GCATCTGCCATTCTTAA | 2715 |
| Haemophilia B Arg94Ser AGAt-AGT | GATGCTGTTACTGTCTATTTTGCTTCTTTTAGATGTAACATGTA ACATTAAGAATGGCAGATGCGAGCAGTTTTGTAAAAATAGTGC TGATAACAAGGTGGTTTGCTCCTGTACTGAGGGA | 2716 |
| | TCCCTCAGTACAGGAGCAAACCACCTTGTTATCAGCACTATTT TTACAAAACTGCTCGCATCTGCCATTCTTAATGTTACATGTTAC ATCTAAAAGAAGCAAAATAGACAGTAACAGCATC | 2717 |
| | AATGGCAGATGCGAGCA | 2718 |
| | TGCTCGCATCTGCCATT | 2719 |
| Haemophilia B Cys95Tyr TGC-TAC | TGCTGTTACTGTCTATTTTGCTTCTTTTAGATGTAACATGTAAC ATTAAGAATGGCAGATGCGAGCAGTTTTGTAAAAATAGTGCTG ATAACAAGGTGGTTTGCTCCTGTACTGAGGGATA | 2720 |
| | TATCCCTCAGTACAGGAGCAAACCACCTTGTTATCAGCACTAT TTTTACAAAACTGCTCGCATCTGCCATTCTTAATGTTACATGTT ACATCTAAAAGAAGCAAAATAGACAGTAACAGCA | 2721 |
| | TGGCAGATGCGAGCAGT | 2722 |
| | ACTGCTCGCATCTGCCA | 2723 |
| Haemophilia B Cys95Trp TGCg-TGG | GCTGTTACTGTCTATTTTGCTTCTTTTAGATGTAACATGTAACA TTAAGAATGGCAGATGCGAGCAGTTTTGTAAAAATAGTGCTGA TAACAAGGTGGTTTGCTCCTGTACTGAGGGATAT | 2724 |
| | ATATCCCTCAGTACAGGAGCAAACCACCTTGTTATCAGCACTA TTTTTACAAAACTGCTCGCATCTGCCATTCTTAATGTTACATGT TACATCTAAAAGAAGCAAAATAGACAGTAACAGC | 2725 |
| | GGCAGATGCGAGCAGTT | 2726 |
| | AACTGCTCGCATCTGCC | 2727 |
| Haemophilia B Cys95Term TGCg-TGA | GCTGTTACTGTCTATTTTGCTTCTTTTAGATGTAACATGTAACA TTAAGAATGGCAGATGCGAGCAGTTTTGTAAAAATAGTGCTGA TAACAAGGTGGTTTGCTCCTGTACTGAGGGATAT | 2728 |
| | ATATCCCTCAGTACAGGAGCAAACCACCTTGTTATCAGCACTA TTTTTACAAAACTGCTCGCATCTGCCATTCTTAATGTTACATGT TACATCTAAAAGAAGCAAAATAGACAGTAACAGC | 2729 |
| | GGCAGATGCGAGCAGTT | 2730 |
| | AACTGCTCGCATCTGCC | 2731 |
| Haemophilia B Gln97Pro CAG-CCG | TACTGTCTATTTTGCTTCTTTTAGATGTAACATGTAACATTAAG AATGGCAGATGCGAGCAGTTTTGTAAAAATAGTGCTGATAACA AGGTGGTTTGCTCCTGTACTGAGGGATATCGACT | 2732 |
| | AGTCGATATCCCTCAGTACAGGAGCAAACCACCTTGTTATCA GCACTATTTTTACAAAACTGCTCGCATCTGCCATTCTTAATGTT ACATGTTACATCTAAAAGAAGCAAAATAGACAGTA | 2733 |
| | ATGCGAGCAGTTTTGTA | 2734 |
| | TACAAAACTGCTCGCAT | 2735 |
| Haemophilia B Gln97Glu gCAG-GAG | TTACTGTCTATTTTGCTTCTTTTAGATGTAACATGTAACATTAA GAATGGCAGATGCGAGCAGTTTTGTAAAAATAGTGCTGATAAC AAGGTGGTTTGCTCCTGTACTGAGGGATATCGAC | 2736 |
| | GTCGATATCCCTCAGTACAGGAGCAAACCACCTTGTTATCAG CACTATTTTTACAAAACTGCTCGCATCTGCCATTCTTAATGTTA CATGTTACATCTAAAAGAAGCAAAATAGACAGTAA | 2737 |

TABLE 21-continued

Factor IX Mutations and Genome-Correcting Oligos

| Clinical Phenotype & Mutation | Correcting Oligos | SEQ ID NO: |
|---|---|---|
| | GATGCGAGCAGTTTTGT | 2738 |
| | ACAAAACTGCTCGCATC | 2739 |
| Haemophilia B Cys99Arg tTGT-CGT | TCTATTTTGCTTCTTTTAGATGTAACATGTAACATTAAGAATGG CAGATGCGAGCAGTTTTGTAAAAATAGTGCTGATAACAAGGTG GTTTGCTCCTGTACTGAGGGATATCGACTTGCAG | 2740 |
| | CTGCAAGTCGATATCCCTCAGTACAGGAGCAAACCACCTTGT TATCAGCACTATTTTTACAAAACTGCTCGCATCTGCCATTCTT AATGTTACATGTTACATCTAAAAGAAGCAAAATAGA | 2741 |
| | AGCAGTTTTGTAAAAAT | 2742 |
| | ATTTTTACAAAACTGCT | 2743 |
| Haemophilia B Cys99Tyr TGT-TAT | CTATTTTGCTTCTTTTAGATGTAACATGTAACATTAAGAATGGC AGATGCGAGCAGTTTTGTAAAAATAGTGCTGATAACAAGGTG GTTTGCTCCTGTACTGAGGGATATCGACTTGCAGA | 2744 |
| | TCTGCAAGTCGATATCCCTCAGTACAGGAGCAAACCACCTTG TTATCAGCACTATTTTTACAAAACTGCTCGCATCTGCCATTCTT AATGTTACATGTTACATCTAAAAGAAGCAAAATAG | 2745 |
| | GCAGTTTTGTAAAAATA | 2746 |
| | TATTTTTACAAAACTGC | 2747 |
| Warfarin sensitivity Ala(-10)Thr cGCC-ACC | TTTTTTGCTAAAACTAAAGAATTATTCTTTTACATTTCAGTTTTT CTTGATCATGAAAACGCCAACAAAATTCTGAATCGGCCAAAGA GGTATAATTCAGGTAAATTGGAAGAGTTTGTTC | 2748 |
| | GAACAAACTCTTCCAATTTACCTGAATTATACCTCTTTGGCCG ATTCAGAATTTTGTTGGCGTTTTCATGATCAAGAAAAACTGAAA TGTAAAAGAATAATTCTTTAGTTTTAGCAAAAAA | 2749 |
| | ATGAAAACGCCAACAAA | 2750 |
| | TTTGTTGGCGTTTTCAT | 2751 |
| Warfarin sensitivity Ala(-10)Val GCC-GTC | TTTTTGCTAAAACTAAAGAATTATTCTTTTACATTTCAGTTTTTC TTGATCATGAAAACGCCAACAAAATTCTGAATCGGCCAAAGAG GTATAATTCAGGTAAATTGGAAGAGTTTGTTCA | 2752 |
| | TGAACAAACTCTTCCAATTTACCTGAATTATACCTCTTTGGCC GATTCAGAATTTTGTTGGCGTTTTCATGATCAAGAAAAACTGA AATGTAAAAGAATAATTCTTTAGTTTTAGCAAAAA | 2753 |
| | TGAAAACGCCAACAAAA | 2754 |
| | TTTTGTTGGCGTTTTCA | 2755 |
| Haemophilia B Gly(-26)Val GGA-GTA | TGCAGCGCGTGAACATGATCATGGCAGAATCACCAGGCCTCA TCACCATCTGCCTTTTAGGATATCTACTCAGTGCTGAATGTAC AGGTTTGTTTCCTTTTTTAAAATACATTGAGTATGC | 2756 |
| | GCATACTCAATGTATTTTAAAAAAGGAAACAAACCTGTACATTC AGCACTGAGTAGATATCCTAAAAGGCAGATGGTGATGAGGCC TGGTGATTCTGCCATGATCATGTTCACGCGCTGCA | 2757 |
| | CCTTTTAGGATATCTAC | 2758 |
| | GTAGATATCCTAAAAGG | 2759 |
| Haemophilia B Leu(-27)Term TTA-TAA | TTATGCAGCGCGTGAACATGATCATGGCAGAATCACCAGGCC TCATCACCATCTGCCTTTTAGGATATCTACTCAGTGCTGAATG TACAGGTTTGTTTCCTTTTTTAAAATACATTGAGTA | 2760 |
| | TACTCAATGTATTTTAAAAAAGGAAACAAACCTGTACATTCAGC ACTGAGTAGATATCCTAAAAGGCAGATGGTGATGAGGCCTGG TGATTCTGCCATGATCATGTTCACGCGCTGCATAA | 2761 |

TABLE 21-continued

Factor IX Mutations and Genome-Correcting Oligos

| Clinical Phenotype & Mutation | Correcting Oligos | SEQ ID NO: |
|---|---|---|
| | CTGCCTTTTAGGATATC | 2762 |
| | GATATCCTAAAAGGCAG | 2763 |
| Haemophilia B Ile(-30)Asn ATC-AAC | TAGCAAAGGTTATGCAGCGCGTGAACATGATCATGGCAGAAT CACCAGGCCTCATCACCATCTGCCTTTTAGGATATCTACTCAG TGCTGAATGTACAGGTTTGTTTCCTTTTTTAAAATA | 2764 |
| | TATTTTAAAAAAGGAAACAAACCTGTACATTCAGCACTGAGTA GATATCCTAAAAGGCAGATGGTGATGAGGCCTGGTGATTCTG CCATGATCATGTTCACGCGCTGCATAACCTTTGCTA | 2765 |
| | CATCACCATCTGCCTTT | 2766 |
| | AAAGGCAGATGGTGATG | 2767 |
| Haemophilia B Ile(-40)Phe gATC-TTC | ACTAATCGACCTTACCACTTTCACAATCTGCTAGCAAAGGTTTA TGCAGCGCGTGAACATGATCATGGCAGAATCACCAGGCCTCA TCACCATCTGCCTTTTAGGATATCTACTCAGTGCTG | 2768 |
| | CAGCACTGAGTAGATATCCTAAAAGGCAGATGGTGATGAGGC CTGGTGATTCTGCCATGATCATGTTCACGCGCTGCATAACCTT TGCTAGCAGATTGTGAAAGTGGTAAGGTCGATTAGT | 2769 |
| | TGAACATGATCATGGCA | 2770 |
| | TGCCATGATCATGTTCA | 2771 |
| Haemophilia B Arg(-44)His CGC-CAC | ACTTTGGTACAACTAATCGACCTTACCACTTTCACAATCTGCT AGCAAAGGTTATGCAGCGCGTGAACATGATCATGGCAGAATC ACCAGGCCTCATCACCATCTGCCTTTTAGGATATCT | 2772 |
| | AGATATCCTAAAAGGCAGATGGTGATGAGGCCTGGTGATTCT GCCATGATCATGTTCACGCGCTGCATAACCTTTGCTAGCAGA TTGTGAAAGTGGTAAGGTCGATTAGTTGTACCAAAGT | 2773 |
| | TATGCAGCGCGTGAACA | 2774 |
| | TGTTCACGCGCTGCATA | 2775 |

EXAMPLE 15

Alpha Thalassemia—Hemoglobin Alpha Locus 1

The thalassemia syndromes are a heterogeneous group of inherited anemias characterized by defects in the synthesis of one or more globin chain subunits. For example, beta-thalassemia discussed in Example 6, is caused by a decrease in beta-chain production relative to alpha-chain production; the converse is the case for alpha-thalassemia. The attached table discloses the correcting oligonucleotide base sequences for the hemoglobin alpha locus 1 oligonucleotides of the invention.

TABLE 22

HBA1 Mutations and Genome-Correcting Oligos

| Clinical Phenotype & Mutation | Correcting Oligos | SEQ ID NO: |
|---|---|---|
| Thalassaemia alpha Met(-1)Val cATG-GTG | CCCTGGCGCGCTCGCGGCCCGGCACTCTTCIGGTCCCCACA GACTCAGAGAGAACCCACCATGGTGCTGICTCCTGCCGACA AGACCAACGTCAAGGCCGCCTGGGGTAAGGTCGGCGCGC | 2776 |
| | GCGCGCCGACCTTACCCCAGGCGGCCTTGACGTTGGTCTTG | 2777 |

TABLE 22-continued

HBA1 Mutations and Genome-Correcting Oligos

| Clinical Phenotype & Mutation | Correcting Oligos | SEQ ID NO: |
|---|---|---|
| | TCGGCAGGAGACAGCACCATGGTGGGTTCTCTCTGAGTCTGT GGGGACCAGAAGAGTGCCGGGCCGCGAGCGCGCCAGGG | |
| | AACCCACCATGGTGCTG | 2778 |
| | CAGCACCATGGTGGGTT | 2779 |
| Haemoglobin variant Ala12Asp GCC-GAC | CACAGACTCAGAGAGAACCCACCATGGTGCTGTCTCCTGCC GACAAGACCAACGTCAAGGCCGCCTGGGGTAAGGTCGGCGC GCACGCTGGCGAGTATGGTGCGGAGGCCCTGGAGAGGTG | 2780 |
| | CACCTCTCCAGGGCCTCCGCACCATACTCGCCAGCGTGCGC GCCGACCTTACCCCAGGCGGCCTTGACGTTGGTCTTGTCGG CAGGAGACAGCACCATGGTGGGTTCTCTCTGAGTCTGTG | 2781 |
| | CGTCAAGGCCGCCTGGG | 2782 |
| | CCCAGGCGGCCTTGACG | 2783 |
| Haemoglobin variant Gly15Asp GGT-GAT | AGAGAGAACCCACCATGGTGCTGTCTCCTGCCGACAAGACCA ACGTCAAGGCCGCCTGGGGTAAGGTCGGCGCGCACGCTGG CGAGTATGGTGCGGAGGCCCTGGAGAGGTGAGGCTCCCT | 2784 |
| | AGGGAGCCTCACCTCTCCAGGGCCTCCGCACCATACTCGCC AGCGTGCGCGCCGACCTTACCCCAGGCGGCCTTGACGTTGG TCTTGTCGGCAGGAGACAGCACCATGGTGGGTTCTCTCT | 2785 |
| | CGCCTGGGGTAAGGTCG | 2786 |
| | CGACCTTACCCCAGGCG | 2787 |
| Haemoglobin variant Tyr24Cys TAT-TGT | CTGCCGACAAGACCMCGTCAAGGCCGCCTGGGGTAAGGTC GGCGCGCACGCTGGCGAGTATGGTGCGGAGGCCCTGGAGA GGTGAGGCTCCCTCCCCTGCTCCGACCCGGGCTCCTCGCC | 2788 |
| | GGCGAGGAGCCCGGGTCGGAGCAGGGGAGGGAGCCTCACC TCTCCAGGGCCTCCGCACCATACTCGCCAGCGTGCGCGCCG ACCTTACCCCAGGCGGCCTTGACGTTGGTCTTGTCGGCAG | 2789 |
| | TGGCGAGTATGGTGCGG | 2790 |
| | CCGCACCATACTCGCCA | 2791 |
| Haemoglobin variant Glu27Asp GAGg-GAT | GACCAACGTCAAGGCCGCCTGGGGTAAGGTCGGCGCGCAC GCTGGCGAGTATGGTGCGGAGGCCCTGGAGAGGTGAGGCT CCCTCCCCTGCTCCGACCCGGGCTCCTCGCCCGCCCGGAC C | 2792 |
| | GGTCCGGGCGGGCGAGGAGCCCGGGTCGGAGCAGGGGAG GGAGCCTCACCTCTCCAGGGCCTCCGCACCATACTCGCCAG CGTGCGCGCCGACCTTACCCCAGGCGGCCTTGACGTTGGTC | 2793 |
| | GGTGCGGAGGCCCTGGA | 2794 |
| | TCCAGGGCCTCCGCACC | 27955 |
| Haemoglobin variant Asn68Lys AACg-AAG | GAGCCACGGCTCTGCCCAGGTTAAGGGCCACGGCAAGAAGG TGGCCGACGCGCTGACCAACGCCGTGGCGCACGTGGACGA CATGCCCAACGCGCTGTCCGCCCTGAGCGACCTGCACGCG | 2796 |
| | CGCGTGCAGGTCGCTCAGGGCGGACAGCGCGTTGGGCATG TCGTCCACGTGCGCCACGGCGTTGGTCAGCGCGTCGGCCAC CTTCTTGCCGTGGCCCTTAACCTGGGCAGAGCCGTGGCTC | 2797 |
| | CTGACCAACGCCGTGGC | 2798 |
| | GCCACGGCGTTGGTCAG | 2799 |
| Haemoglobin variant Asp74Gly GAC-GGC | AGGTTAAGGGCCACGGCAAGAAGGTGGCCGACGCGCTGACC AACGCCGTGGCGCACGTGGACGACATGCCCAACGCGCTGTC CGCCCTGAGCGACCTGCACGCGCACAAGCHCGGGTGGA | 2800 |
| | TCCACCCGAAGCTTGTGCGCGTGCAGGTCGCTCAGGGCGGA CAGCGCGTTGGGCATGTCGTCCACGTGCGCCACGGCGTTGG | 2801 |

TABLE 22-continued

HBA1 Mutations and Genome-Correcting Oligos

| Clinical Phenotype & Mutation | Correcting Oligos | SEQ ID NO: |
|---|---|---|
| | TCAGCGCGTCGGCCACCTTCTTGCCGTGGCCCTTAACCT | |
| | GCACGTGGACGACATGC | 2802 |
| | GCATGTCGTCCACGTGC | 2803 |
| Haemoglobin variant Asp74His gGAC-CAC | CAGGTTAAGGGCCACGGCAAGAAGGTGGCCGACGCGCTGAC CAACGCCGTGGCGCACGTGGACGACATGCCCAACGCGCTGT CCGCCCTGAGCGACCTGCACGCGCACAAGCTTCGGGTGG | 2804 |
| | CCACCCGAAGCTTGTGCGCGTGCAGGTCGCTCAGGGCGGAC AGCGCGTTGGGCATGTCGTCCACGTGCGCCACGGCGTTGGT CAGCGCGTCGGCCACCTTCTTGCCGTGGCCCTTAACCTG | 2805 |
| | CGCACGTGGACGACATG | 2806 |
| | CATGTCGTCCACGTGCG | 2807 |
| Haemoglobin variant Asn78His cAAC-CAC | CACGGCAAGAAGGTGGCCGACGCGCTGACCAACGCCGTGG CGCACGTGGACGACATGCCCAACGCGCTGTCCGCCCTGAGC GACCTGCACGCGCACAAGCTTCGGGTGGACCCGGTCAACT | 2808 |
| | AGTTGACCGGGTCCACCCGAAGCTTGTGCGCGTGCAGGTCG CTCAGGGCGGACAGCGCGTTGGGCATGTCGTCCACGTGCGC CACGGCGTTGGTCAGCGCGTCGGCCACCTTCTTGCCGTG | 2809 |
| | ACATGCCCAACGCGCTG | 2810 |
| | CAGCGCGTTGGGCATGT | 2811 |
| Haemoglobin variant His87Tyr gCAC-TAC | ACCAACGCCGTGGCGCACGTGGACGACATGCCCAACGCGCT GTCCGCCCTGAGCGACCTGCACGCGCACAAGCTTCGGGTGG ACCCGGTCAACTTCAAGGTGAGCGGCGGGCCGGGAGCGA | 2812 |
| | TCGCTCCCGGCCCGCCGCTCACCTTGAAGTTGACCGGGTCC ACCCGAAGCTTGTGCGCGTGCAGGTCGCTCAGGGCGGACAG CGCGTTGGGCATGTCGTCCACGTGCGCCACGGCGHGGT | 2813 |
| | GCGACCTGCACGCGCAC | 2814 |
| | GTGCGCGTGCAGGTCGC | 2815 |
| Haemoglobin variant Lys90Asn AAGc-AAC | GGCGCACGTGGACGACATGCCCAACGCGCTGTCCGCCCTGA GCGACCTGCACGCGCACAAGCTTCGGGTGGACCCGGTCAAC TTCAAGGTGAGCGGCGGGCCGGGAGCGATCTGGGTCGAG | 2816 |
| | CTCGACCCAGATCGCTCCCGGCCCGCCGCTCACCTTGAAGT TGACCGGGTCCACCCGAAGCTTGTGCGCGTGCAGGTCGCTC AGGGCGGACAGCGCGTTGGGCATGTCGTCCACGTGCGCC | 2817 |
| | GCGCACAAGCTTCGGGT | 2818 |
| | ACCCGAAGCTTGTGCGC | 2819 |
| Haemoglobin variant Lys90Thr AAG-ACG | TGGCGCACGTGGACGACATGCCCAACGCGCTGTCCGCCCTG AGCGACCTGCACGCGCACAAGCTTCGGGTGGACCCGGTCAA CTTCAAGGTGAGCGGCGGGCCGGGAGCGATCTGGGTCGA | 2820 |
| | TCGACCCAGATCGCTCCCGGCCCGCCGCTCACCTTGAAGTT GACCGGGTCCACCCGAAGCTTGTGCGCGTGCAGGTCGCTCA GGGCGGACAGCGCGTTGGGCATGTCGTCCACGTGCGCCA | 2821 |
| | CGCGCACAAGCTTCGGG | 2822 |
| | CCCGAAGCTTGTGCGCG | 2823 |
| Haemoglobin variant Arg92Gln CGG-CAG | ACGTGGACGACATGCCCAACGCGCTGTCCGCCCTGAGCGAC CTGCACGCGCACAAGCTTCGGGTGGACCCGGTCAACTTCAA GGTGAGCGGCGGGCCGGGAGCGATCTGGGTCGAGGGGCG | 2824 |
| | CGCCCCTCGACCCAGATCGCTCCCGGCCCGCCGCTCACCTT GAAGTTGACCGGGTCCACCCGAAGCTTGTGCGCGTGCAGGT CGCTCAGGGCGGACAGCGCGTTGGGCATGTCGTCCACGT | 2825 |

TABLE 22-continued

HBA1 Mutations and Genome-Correcting Oligos

| Clinical Phenotype & Mutation | Correcting Oligos | SEQ ID NO: |
|---|---|---|
| | CAAGCTTCGGGTGGACC | 2826 |
| | GGTCCACCCGAAGCTTG | 2827 |
| Haemoglobin variant Asp94Gly GAC-GGC | ACGACATGCCCAACGCGCTGTCCGCCCTGAGCGACCTGCAC GCGCACAAGCTTCGGGTGGACCCGGTCAACTTCAAGGTGAG CGGCGGGCCGGGAGCGATCTGGGTCGAGGGGCGAGATGG | 2828 |
| | CCATCTCGCCCCTCGACCCAGATCGCTCCCGGCCCGCCGCT CACCTTGAAGTTGACCGGGTCCACCCGAAGCTTGTGCGCGT GCAGGTCGCTCAGGGCGGACAGCGCGTTGGGCATGTCGT | 2829 |
| | TCGGGTGGACCCGGTCA | 2830 |
| | TGACCGGGTCCACCCGA | 2831 |
| Haemoglobin variant Pro95Arg CCG-CGG | ACATGCCCAACGCGCTGTCCGCCCTGAGCGACCTGCACGCG CACAAGCTTCGGGTGGACCCGGTCAACTTCAAGGTGAGCGG CGGGCCGGGAGCGATCTGGGTCGAGGGGCGAGATGGCGC | 2832 |
| | GCGCCATCTCGCCCCTCGACCCAGATCGCTCCCGGCCCGCC GCTCACCTTGAAGTTGACCGGGTCCACCCGAAGCTTGTGCG CGTGCAGGTCGCTCAGGGCGGACAGCGCGTTGGGCATGT | 2833 |
| | GGTGGACCCGGTCAACT | 2834 |
| | AGTTGACCGGGTCCACC | 2835 |
| Haemoglobin variant Ser102Arg AGCc-AGA | CGGCGGCTGCGGGCCTGGGCCCTCGGCCCCACTGACCCTC TCTCTGCACAGCTCCTAAGCCACTGCCTGCTGGTGACCCTG GCCGCCCACCTCCCCGCCGAGTTCACCCCTGCGGTGCAC | 2836 |
| | GTGCACCGCAGGGGTGAACTCGGCGGGGAGGTGGGCGGCC AGGGTCACCAGCAGGCAGTGGCTTAGGAGCTGTGCAGAGAA GAGGGTCAGTGGGGCCGAGGGCCCAGGCCCGCAGCCGCCG | 2837 |
| | CTCCTAAGCCACTGCCT | 2838 |
| | AGGCAGTGGCTTAGGAG | 2839 |
| Haemoglobin variant Glu116Lys cGAG-AAG | TTCTCTGCACAGCTCCTAAGCCACTGCCTGCTGGTGACCCTG GCCGCCCACCTCCCCGCCGAGTTCACCCCTGCGGTGCACGC CTCCCTGGACAAGTTCCTGGCTTCTGTGAGCACCGTGC | 2840 |
| | GCACGGTGCTCACAGAAGCCAGGAACTTGTCCAGGGAGGCG TGCACCGCAGGGGTGAACTCGGCGGGGAGGTGGGCGGCCA GGGTCACCAGCAGGCAGTGGCTTAGGAGCTGTGCAGAGAA | 2841 |
| | TCCCCGCCGAGTTCACC | 2842 |
| | GGTGAACTCGGCGGGGA | 2843 |
| Haemoglobin variant Ala120Glu GCG-GAG | TCCTAAGCCACTGCCTGCTGGTGACCCTGGCCGCCCACCTC CCCGCCGAGTTCACCCCTGCGGTGCACGCCTCCCTGGACAA GTTCCTGGCTTCTGTGAGCACCGTGCTGACCTCCAAATA | 2844 |
| | TATTTGGAGGTCAGCACGGTGCTCACAGAAGCCAGGAACTTG TCCAGGGAGGCGTGCACCGCAGGGGTGAACTCGGCGGGGA GGTGGGCGGCCAGGGTCACCAGCAGGCAGTGGCTTAGGA | 2845 |
| | CACCCCTGCGGTGCACG | 2846 |
| | CGTGCACCGCAGGGGTG | 2847 |
| Thalassaemia alpha Leu129Pro CTG-CCG | TGGCCGCCCACCTCCCCGCCGAGTTCACCCCTGCGGTGCAC GCCTCCCTGGACAAGTTCCTGGCTTCTGTGAGCACCGTGCTG ACCTCCAAATACCGTTAAGCTGGAGCCTCGGTGGCCAT | 2848 |
| | ATGGCCACCGAGGCTCCAGCNAACGGTATTTGGAGGTCAGC ACGGTGCTCACAGAAGCCAGGAACTTGTCCAGGGAGGCGTG CACCGCAGGGGTGAACTCGGCGGGGAGGTGGGCGGCCA | 2849 |

TABLE 22-continued

HBA1 Mutations and Genome-Correcting Oligos

| Clinical Phenotype & Mutation | Correcting Oligos | SEQ ID NO: |
|---|---|---|
| | CAAGTTCCTGGCTTCTG | 2850 |
| | CAGAAGCCAGGAACTTG | 2851 |
| Haemoglobin variant Arg141Leu CGT-CTT | TGCACGCCTCCCTGGACAAGTTCCTGGCTTCTGTGAGCACCG TGCTGACCTCCAAATACCGTTAAGCTGGAGCCTCGGTGGCCA TGCTTCTTGCCCCTTGGGCCTCCCCCCAGCCCCTCCT | 2852 |
| | AGGAGGGGCTGGGGGGAGGCCCAAGGGGCMGMGCATGG CCACCGAGGCTCCAGCTTAACGGTATTTGGAGGTCAGCACG GTGCTCACAGAAGCCAGGAACTTGTCCAGGGAGGCGTGCA | 2853 |
| | CMATACCGTTAAGCTG | 2854 |
| | CAGCTTAACGGTATTTG | 2855 |

EXAMPLE 16

Alpha-thalassemia—Hemoglobin Alpha Locus 2

The attached table discloses the correcting oligonucleotide base sequences for the hemoglobin alpha locus 2 oligonucleotides of the invention.

TABLE 23

HBA2 Mutations and Genome-Correcting Oligos

| Clinical Phenotype & Mutation | Correcting Oligos | SEQ ID NO |
|---|---|---|
| Thalassaemia alpha Met(-1)Thr ATG-ACG | CCTGGCGCGCTCGCGGGCCGGCACTCTTCTGGTCCCCACAG ACTCAGAGAGAACCCACCATGGTGCTGTCTCCTGCCGACAAG ACCAACGTCAAGGCCGCCTGGGGTAAGGTCGGCGCGCA | 2856 |
| | TGCGCGCCGACCTTACCCCAGGCGGCCTTGACGTTGGTCTT GTCGGCAGGAGACAGCACCATGGTGGGTTCTCTCTGAGTCT GTGGGGACCAGAAGAGTGCCGGCCCGCGAGCGCGCCAGG | 2857 |
| | ACCCACCATGGTGCTGT | 2858 |
| | ACAGCACCATGGTGGGT | 2859 |
| Haemoglobin variant Ala12Asp GCC-GAC | CACAGACTCAGAGAGAACCCACCATGGTGCTGTCTCCTGCC GACAAGACCAACGTCAAGGCCGCCTGGGGTAAGGTCGGCGC GCACGCTGGCGAGTATGGTGCGGAGGCCCTGGAGAGGTG | 2860 |
| | CACCTCTCCAGGGCCTCCGCACCATACTCGCCAGCGTGCGC 2861 GCCGACCTTACCCCAGGCGGCCTTGACGTTGGTCTTGTCGG CAGGAGACAGCACCATGGTGGGTTCTCTCTGAGTCTGTG | |
| | CGTCAAGGCCGCCTGGG | 2862 |
| | CCCAGGCGGCCTTGACG | 2863 |
| Haemoglobin variant Lys16Glu tAAG-GAG | AGAGAACCCACCATGGTGCTGTCTCCTGCCGACAAGACCAAC GTCAAGGCCGCCTGGGGTAAGGTCGGCGCGCACGCTGGCG AGTATGGTGCGGAGGCCCTGGAGAGGTGAGGCTCCCTCC | 2864 |
| | GGAGGGAGCCTCACCTCTCCAGGGCCTCCGCACCATACTCG 2865 CCAGCGTGCGCGCCGACCTTACCCCAGGCGGCCTTGACGTT GGTCTTGTCGGCAGGAGACAGCACCATGGTGGGTTCTCT | |
| | CCTGGGGTAAGGTCGGC | 2866 |
| | GCCGACCTTACCCCAGG | 2867 |

TABLE 23-continued

HBA2 Mutations and Genome-Correcting Oligos

| Clinical Phenotype & Mutation | Correcting Oligos | SEQ ID NO |
|---|---|---|
| Haemoglobin variant His20Gln CACg-CAA | GGTGCTGTCTCCTGCCGACAAGACCAACGTCAAGGCCGCCT GGGGTAAGGTCGGCGCGCACGCTGGCGAGTATGGTGCGGA GGCCCTGGAGAGGTGAGGCTCCCTCCCCTGCTCCGACCCG | 2868 |
| | CGGGTCGGAGCAGGGGAGGGAGCCTCACCTCTCCAGGGCC TCCGCACCATACTCGCCAGCGTGCGCGCCGACCTTACCCCA GGCGGCCTTGACGTTGGTCTTGTCGGCAGGAGACAGCACC | 2869 |
| | GGCGCGCACGCTGGCGA | 2870 |
| | TCGCCAGCGTGCGCGCC | 2871 |
| Haemoglobin variant Glu27Asp GAGg-GAC | GACCAACGTCAAGGCCGCCTGGGGTAAGGTCGGCGCGCAC GCTGGCGAGTATGGTGCGGAGGCCCTGGAGAGGTGAGGCT CCCTCCCCTGCTCCGACCCGGGCTCCTCGCCCGCCCGGAC C | 2872 |
| | GGTCCGGGCGGGCGAGGAGCCCGGGTCGGAGCAGGGGAG GGAGCCTCACCTCTCCAGGGCCTCCGCACCATACTCGCCAG CGTGCGCGCCGACCTTACCCCAGGCGGCCHGACGHGGTC | 2873 |
| | GGTGCGGAGGCCCTGGA | 2874 |
| | TCCAGGGCCTCCGCACC | 2875 |
| Thalassaemia alpha Leu29Pro CTG-CCG | ACGTCAAGGCCGCCTGGGGTAAGGTCGGCGCGCACGCTGG CGAGTATGGTGCGGAGGCCCTGGAGAGGTGAGGCTCCCTCC CCTGCTCCGACCCGGGCTCCTCGCCCGCCCGGACCCACAG | 2876 |
| | CTGTGGGTCCGGGCGGGCGAGGAGCCCGGGTCGGAGCAGG 2877 GGAGGGAGCCTCACCTCTCCAGGGCCTCCGCACCATACTCG CCAGCGTGCGCGCCGACCTTACCCCAGGCGGCCTTGACGT | |
| | GGAGGCCCTGGAGAGGT | 2878 |
| | ACCTCTCCAGGGCCTCC | 2879 |
| Haemoglobin variant Asp47His cGAC-CAC | GCTTCTCCCCGCAGGATGTTCCTGTCCTTCCCCACCACCAAG ACCTACTTCCCGCACTTCGACCTGAGCCACGGCTCTGCCCA GGHAAGGGCCACGGCAAGAAGGTGGCCGACGCGCTGA | 2880 |
| | TCAGCGCGTCGGCCACCTTCTTGCCGTGGCCCTTAACCTGG GCAGAGCCGTGGCTCAGGTCGAAGTGCGGGAAGTAGGTCTT GGTGGTGGGGAAGGACAGGAACATCCTGCGGGGAGAAGC | 2881 |
| | CGCACTTCGACCTGAGC | 2882 |
| | GCTCAGGTCGAAGTGCG | 2883 |
| Haemoglobin variant Leu48Arg CTG-CGG | CTCCCCGCAGGATGTTCCTGTCCTTCCCCACCACCAAGACCT ACTTCCCGCACTTCGACCTGAGCCACGGCTCTGCCCAGGTTA AGGGCCACGGCAAGAAGGTGGCCGACGCGCTGACCAA | 2884 |
| | TTGGTCAGCGCGTCGGCCACCTTCTTGCCGTGGCCCTTAAC CTGGGCAGAGCCGTGGCTCAGGTCGAAGTGCGGGAAGTAG GTCTTGGTGGTGGGGAAGGACAGGAACATCCTGCGGGGAG | 2885 |
| | CTTCGACCTGAGCCACG | 2886 |
| | CGTGGCTCAGGTCGAAG | 2887 |
| Haemoglobin variant Gln54Glu cCAG-GAG | CTGTCCTTCCCCACCACCAAGACCTACTTCCCGCACTTCGAC CTGAGCCACGGCTCTGCCCAGGTTAAGGGCCACGGCAAGAA GGTGGCCGACGCGCTGACCAACGCCGTGGCGCACGTGG | 2888 |
| | CCACGTGCGCCACGGCGTTGGTCAGCGCGTCGGCCACCHC 2889 TTGCCGTGGCCCTTAACCTGGGCAGAGCCGTGGCTCAGGTC GAAGTGCGGGAAGTAGGTCTTGGTGGTGGGGAAGGACAG | |

TABLE 23-continued

HBA2 Mutations and Genome-Correcting Oligos

| Clinical Phenotype & Mutation | Correcting Oligos | SEQ ID NO |
|---|---|---|
| | GCTCTGCCCAGGTTAAG | 2890 |
| | CTTAACCTGGGCAGAGC | 2891 |
| Haemoglobin variant Gly59Asp GGC-GAC | CCAAGACCTACTTCCCGCACTTCGACCTGAGCCACGGCTCTG CCCAGGTTAAGGGCCACGGCAAGAAGGTGGCCGACGCGCT GACCAACGCCGTGGCGCACGTGGACGACATGCCCAACGC | 2892 |
| | GCGTTGGGCATGTCGTCCACGTGCGCCACGGCGTTGGTCAG CGCGTCGGCCACCTTCTTGCCGTGGCCCTTAACCTGGGCAG AGCCGTGGCTCAGGTCGAAGTGCGGGAAGTAGGTCTTGG | 2893 |
| | GGGCCACGGCAAGAAGG | 2894 |
| | CCTTCTTGCCGTGGCCC | 2895 |
| Haemoglobin variant Asn68Lys AACg-AAG | GAGCCACGGCTCTGCCCAGGTTAAGGGCCACGGCAAGAAGG TGGCCGACGCGCTGACCAACGCCGTGGCGCACGTGGACGA T CATGCCCAACGCGCTGTCCGCCCTGAGCGACCTGCACGCG | 2896 |
| | CGCGTGCAGGTCGCTCAGGGCGGACAGCGCGTTGGGCATG TCGTCCACGTGCGCCACGGCGTTGGTCAGCGCGTCGGCCAC CTTCTTGCCGTGGCCCTTAACCTGGGCAGAGCCGTGGCTC | 2897 |
| | CTGACCAACGCCGTGGC | 2898 |
| | GCCACGGCGTTGGTCAG | 2899 |
| Haemoglobin variant Asn68Lys AACg-AAA | GAGCCACGGCTCTGCCCAGGTAAAGGGCCACGGCAAGAAGG TGGCCGACGCGCTGACCAACGCCGTGGCGCACGTGGACGA CATGCCCAACGCGCTGTCCGCCCTGAGCGACCTGCACGCG | 2900 |
| | CGCGTGCAGGTCGCTCAGGGCGGACAGCGCGTTGGGCATG TCGTCCACGTGCGCCACGGCGTTGGTCAGCGCGTCGGCCAC CTTCTTGCCGTGGCCCTTAACCTGGGCAGAGCCGTGGCTC | 2901 |
| | CTGACCAACGCCGTGGC | 2902 |
| | GCCACGGCGTTGGTCAG | 2903 |
| Haemoglobin variant Asn78Lys AACg-AAA | CGGCAAGAAGGTGGCCGACGCGCTGACCAACGCCGTGGCG CACGTGGACGACATGCCCAACGCGCTGTCCGCCCTGAGCGA CCTGCACGCGCACAAGCTTGGGTGGACCCGGTCAACTTC | 2904 |
| | GAAGTTGACCGGGTCCACCCGAAGCTTGTGCGCGTGCAGGT CGCTCAGGGCGGACAGCGCGTTGGGCATGTCGTCCACGTGC GCCACGGCGTTGGTCAGCGCGTCGGCCACCTTCTTGCCG | 2905 |
| | ATGCCCAACGCGCTGTC | 2906 |
| | GACAGCGCGTTGGGCAT | 2907 |
| Haemoglobin variant Asp85Val GAC-GTC | CGCTGACCAACGCCGTGGCGCACGTGGACGACATGCCCAAC GCGCTGTCCGCCCTGAGCGACCTGCACGCGCACAAGCTTCG GGTGGACCCGGTCAACTTCAAGGTGAGCGGCGGGCCGGG | 2908 |
| | CCCGGCCCGCCGCTCACCTTGAAGTTGACCGGGTCCACCCG AAGCTTGTGCGCGTGCAGGTCGCTCAGGGCGGACAGCGCGT TGGGCATGTCGTCCACGTGCGCCACGGCGTTGGTCAGCG | 2909 |
| | CCTGAGCGACCTGCACG | 2910 |
| | CGTGCAGGTCGCTCAGG | 2911 |
| Haemoglobin variant Lys90Asn AAGc-AAT | GGCGCACGTGGACGACATGCCCAACGCGCTGTCCGCCCTGA GCGACCTGCACGCGCACAAGCTTCGGGTGGACCCGGTCAAC TTCAAGGTGAGCGGCGGGCCGGGAGCGATCTGGGTCGAG | 2912 |
| | CTCGACCCAGATCGCTCCCGGCCCGCCGCTCACCTTGAAGT TGACCGGGTCCACCCGAAGCTTGTGCGCGTGCAGGTCGCTC | 2913 |

TABLE 23-continued

HBA2 Mutations and Genome-Correcting Oligos

| Clinical Phenotype & Mutation | Correcting Oligos | SEQ ID NO |
|---|---|---|
| | AGGGCGGACAGCGCGTTGGGCATGTCGTCCACGTGCGCC | |
| | GCGCACAAGCTTCGGGT | 2914 |
| | ACCCGAAGCTTGTGCGC | 2915 |
| Haemoglobin variant Asp94His gGAC-CAC | GACGACATGCCCAACGCGCTGTCCGCCCTGAGCGACCTGCA CGCGCACAAGCTTCGGGTGGACCCGGTCAACTTCAAGGTGA GCGGCGGGCCGGGAGCGATCTGGGTCGAGGGGCGAGATG | 2916 |
| | CATCTCGCCCCTCGACCCAGATCGCTCCCGGCCCGCCGCTC ACCTTGAAGTTGACCGGGTCCACCCGAAGCTTGTGCGCGTG CAGGTCGCTCAGGGCGGACAGCGCGTTGGGCATGTCGTC | 2917 |
| | TTCGGGTGGACCCGGTC | 2918 |
| | GACCGGGTCCACCCGAA | 2919 |
| Haemoglobin variant Pro95Leu CCG-CTG | ACATGCCCAACGCGCTGTCCGCCCTGAGCGACCTGCACGCG CACAAGCTTCGGGTGGACCCGGTCAACTTCAAGGTGAGCGG CGGGCCGGGAGCGATCTGGGTCGAGGGGCGAGATGGCGC | 2920 |
| | GCGCCATCTCGCCCCTCGACCCAGATCGCTCCCGGCCCGCC GCTCACCTTGAAGTTGACCGGGTCCACCCGAAGCTTGTGCG CGTGCAGGTCGCTCAGGGCGGACAGCGCGTTGGGCATGT | 2921 |
| | GGTGGACCCGGTCAACT | 2922 |
| | AGTTGACCGGGTCCACC | 2923 |
| Haemoglobin variant Ser102Arg aAGC-CGC | TAGCGCAGGCGGCGGCTGCGGGCCTGGGCCGCACTGACCC TCTTCTCTGCACAGCTCCTAAGCCACTGCCTGCTGGTGACCC TGGCCGCCCACCTCCCCGCCGAGTTCACCCCTGCGGTGC | 2924 |
| | GCACCGCAGGGGTGAACTCGGCGGGGAGGTGGGCGGCCAG GGTCACCAGCAGGCAGTGGCTTAGGAGCTGTGCAGAGAAGA GGGTCAGTGCGGCCCAGGCCCGCAGCCGCCGCCTGCGCTA | 2925 |
| | AGCTCCTAAGCCACTGC | 2926 |
| | GCAGTGGCTTAGGAGCT | 2927 |
| Haemoglobin H disease Cys104Tyr TGC-TAC | GGCGGCGGCTGCGGGCCTGGGCCGCACTGACCCTCTTCTCT GCACAGCTCCTAAGCCACTGCCTGCTGGTGACCCTGGCCGC CCACCTCCCCGCCGAGTTCACCCCTGCGGTGCACGCCTC | 2928 |
| | GAGGCGTGCACCGCAGGGGTGAACTCGGCGGGGAGGTGGG CGGCCAGGGTCACCAGCAGGCAGTGGCTTAGGAGCTGTGCA GAGAAGAGGGTCAGTGCGGCCCAGGCCCGCAGCCGCCGCC | 2929 |
| | AAGCCACTGCCTGCTGG | 2930 |
| | CCAGCAGGCAGTGGCTT | 2931 |
| Haemoglobin variant Ala111Val GCC-GTC | CCGCACTGACCCTCTTCTCTGCACAGCTCCTAAGCCACTGCC TGCTGGTGACCCTGGCCGCCCACCTCCCCGCCGAGTTCACC CCTGCGGTGCACGCCTCCCTGGACAAGTTCCTGGCTTC | 2932 |
| | GAAGCCAGGAACTTGTCCAGGGAGGCGTGCACCGCAGGGGT GAACTCGGCGGGGAGGTGGGCGGCCAGGGTCACCAGCAGG CAGTGGCTTAGGAGCTGTGCAGAGAAGAGGGTCAGTGCGG | 2933 |
| | CCTGGCCGCCCACCTCC | 2934 |
| | GGAGGTGGGCGGCCAGG | 2935 |
| Haemoglobin variant Ala210Glu GCG-GAG | TCCTAAGCCACTGCCTGCTGGTGACCCTGGCCGCCCACCTC CCCGCCGAGTTCACCCCTGCGGTGCACGCCTCCCTGGACAA GTTCCTGGCTTCTGTGAGCACCGTGCTGACCTCCAAATA | 2936 |
| | TATTTGGAGGTCAGCACGGTGCTCACAGAAGCCAGGAACTTG TCCAGGGAGGCGTGCACCGCAGGGGTGAACTCGGCGGGGA GGTGGGCGGCCAGGGTCACCAGCAGGCAGTGGCTTAGGA | 2937 |

TABLE 23-continued

HBA2 Mutations and Genome-Correcting Oligos

| Clinical Phenotype & Mutation | Correcting Oligos | SEQ ID NO |
|---|---|---|
| | CACCCCTGCGGTGCACG | 2938 |
| | CGTGCACCGCAGGGGTG | 2939 |
| Haemoglobin variant His122Gln CACq-CAG | CCACTGCCTGCTGGTGACCCTGGCCGCCCACCTCCCCGCCG AGTTCACCCCTGCGGTGCACCGCCTCCCTGGACAAGTTCCTG GCTTCTGTGAGCACCGTGCTGACCTCCAAATACCGTTAA | 2940 |
| | TTAACGGTATTTGGAGGTCAGCACGGTGCTCACAGAAGCCAG GAACTTGTCCAGGGAGGCGTGCACCGCAGGGGTGAACTCGG CGGGGAGGTGGGCGGCCAGGGTCACCAGCAGGCAGTGG | 2941 |
| | GCGGTGCACGCCTCCCT | 2942 |
| | AGGGAGGCGTGCACCGC | 2943 |
| Haemoglobin variant Ala123Ser cGCC-TCC | CACTGCCTGCTGGTGACCCTGGCCGCCCACCTCCCCGCCGA GTTCACCCCTGCGGTGCACGCCTCCCTGGACAAGTTCCTGG CTTCTGTGAGCACCGTGCTGACCTCCAAATACCGTTAAG | 2944 |
| | CTTAACGGTATTTGGAGGTCAGCACGGTGCTCACAGAAGCCA GGAACTTGTCCAGGGAGGCGTGCACCGCAGGGGTGAACTCG GCGGGGAGGTGGGCGGCCAGGGTCACCAGCAGGCAGTG | 2945 |
| | CGGTGCACGCCTCCCTG | 2946 |
| | CAGGGAGGCGTGCACCG | 2947 |
| Thalassaemia alpha Leu125Pro CTG-CCG | TGCTGGTGACCCTGGCCGCCCACCTCCCCGCCGAGTTCACC CCTGCGGTGCACGCCTCCCTGGACAAGTTCCTGGCTTCTGT GAGCACCGTGCTGACCTCCAAATACCGTTAAGCTGGAGC | 2948 |
| | GQTCCAGCTTAACGGTATTTGGAGGTCAGCACGGTGCTCACA GAAGCCAGGAACHGTCCAGGGAGGCGTGCACCGCAGGGG TGAACTCGGCGGGAGGTGGGCGGCCAGGGTCACCAGCA | 2949 |
| | CGCCTCCCTGGACAAGT | 2950 |
| | ACTTGTCCAGGGAGGCG | 2951 |
| Haemoglobin variant Ser131Pro tTCT-CCT | GCCCACCTCCCCGCCGAGTTCACCCCTGCGGTGCACGCCTC CCTGGACAAGTfCCTGGCTTCTGTGAGCACCGTGCTGACCTC CAAATACCGTTAAGCTGGAGCCTCGGTAGCCGTTCCTC | 2952 |
| | GAGGAACGGCTACCGAGGCTCCAGCTTAACGGTATTTGGAG GTCAGCACGGTGCTCACAGAAGCCAGGAACTTGTCCAGGGA GGCGTGCACCGCAGGGGTGAACTCGGCGGGAGGTGGGC | 2953 |
| | TCCTGGCTTCTGTGAGC | 2954 |
| | GCTCACAGAAGCCAGGA | 2955 |
| Haemoglobin variant Leu136Met gCTG-ATG | GAGTTCACCCCTGCGGTGCACGCCTCCCTGGACAAGTTCCT GGCTTCTGTGAGCACCGTGCTGACCTCCAAATACCGTTAAGC TGGAGCCTCGGTAGCCGTTCCTCCTGCCCGCTGGGCCT | 2956 |
| | AGGCCCAGCGGGCAGGAGGAACGGCTACCGAGGCTCCAGC TTAACGGTATTTGGAGGTCAGCACGGTGCTCACAGAAGCCAG GAACTTGTCCAGGGAGGCGTGCACCGCAGGGGTGAACTC | 2957 |
| | GCACCGTGCTGACCTCC | 2958 |
| | GGAGGTCAGCACGGTGC | 2959 |
| Haemoglobin variant Leu136Pro CTG-CCG | AGTTCACCCCTGCGGTGCACGCCTCCCTGGACAAGTTCCTG GCTTCTGTGAGCACCGTGCTGACCTCCAAATACCGTTAAGCT GGAGCCTCGGTAGCCGTTCCTCCTGCCCGCTGGGCCTC | 2960 |
| | GAGGCCCAGCGGGCAGGAGGAACGGCTACCGAGGCTCCAG CTTAACGGTATTTGGAGGTCAGCACGGTGCTCACAGAAGCCA GGAACTTGTCCAGGGAGGCGTGCACCGCAGGGGTGAACT | 2961 |

TABLE 23-continued

HBA2 Mutations and Genome-Correcting Oligos

| Clinical Phenotype & Mutation | Correcting Oligos | SEQ ID NO |
|---|---|---|
| | CACCGTGCTGACCTCCA | 2962 |
| | TGGAGGTCAGCACGGTG | 2963 |
| Haemoglobin variant Arg141Cys cCGT-TGT | GTGCACGCCTCGCTGGACAAGTTCCTGGCTTCTGTGAGCACC GTGCTGACCTCCAAATACCGTTAAGCTGGAGCCTCGGTAGCC GTTCCTCCTGCCCGCTGGGCCTCCCAACGGGCCCTCC | 2964 |
| | GGAGGGCCCGTTGGGAGGCCCAGCGGGGAGGAGGAACGGC TACCGAGGCTCCAGCTTAACGGTATTTGGAGGTCAGCACGGT GCTCACAGAAGCCAGGAACTTGTCCAGGGAGGCGTGCAC | 2965 |
| | CCAAATACCGTTAAGCT | 2966 |
| | AGCTTAACGGTATTTGG | 2967 |
| Haemoglobin variant Term142Gln tTAA-CAA | CACGCCTCCCTGGACAAGTTCCTGGCTTCTGTGAGCACCGTG CTGACCTCCAAATACCGTTAAGCTGGAGCCTCGGTAGCCGTT CCTCCTGCCCGCTGGGCCTCCCAACGGGCCCTCCTCC | 2968 |
| | GGAGGAGGGCCCGTTGGGAGGCCCAGCGGGCAGGAGGAAC GGCTACCGAGGCTCCAGCTTAACGGTATTTGGAGGTCAGCA CGGTGCTCACAGAAGCCAGGAACTTGTCCAGGGAGGCGTG | 2969 |
| | AATACCGTTAAGCTGGA | 2970 |
| | TCCAGCTTAACGGTATT | 2971 |
| Haemoglobin variant Term142Lys tTAA-AAA | CACGCCTCCCTGGACAAGTTCCTGGCTTCTGTGAGCACCGTG CTGACCTCCAAATACCGTTAAGCTGGAGCCTCGGTAGCCGTT CCTCCTGCCCGCTGGGCCTCCCAACGGGCCCTCCTCC | 2972 |
| | GGAGGAGGGCCCGTTGGGAGGCCCAGCGGGCAGGAGGAAC GGCTACCGAGGCTCCAGCTTAACGGTATTTGGAGGTCAGCA CGGTGCTCACAGAAGCCAGGAACTTGTCCAGGGAGGCGTG | 2973 |
| | AATACCGTTAAGCTGGA | 2974 |
| | TCCAGCTTAACGGTATT | 2975 |
| Haemoglobin variant Term142Tyr TAAg-TAT | CGCCTCCGTGGACAAGTTCCTGGCTTCTGTGAGCACCGTGCT GACCTCCAAATACCGTTAAGCTGGAGCCTCGGTAGCCGTTCC TCCTGCCCGCTGGGCCTCCCAACGGGCCCTCCTCCCC | 2976 |
| | GGGGAGGAGGGCCCGTTGGGAGGCCCAGCGGGCAGGAGG AACGGCTACCGAGGCTCCAGCTTAACGGTATTTGGAGGTCAG CACGGTGCTCACAGAAGCCAGGAACHGTCCAGGGAGGCG | 2977 |
| | TACCGTTAAGCTGGAGC | 2978 |
| | GCTCCAGCTTAACGGTA | 2979 |

EXAMPLE 17

Human Mismatch Repair—MLH1

The human MLH1 gene is homologous to the bacterial mutL gene, which is involved in mismatch repair. Mutations in the MLH1 gene have been identified in many individuals with hereditary nonpolyposis colorectal cancer (HNPCC). Mutations in the MLH1 gene are also implicated in predisposition to a variety of cancers associated with, for example, Muir-Torre syndrome and Turcot syndrome. The attached table discloses the correcting oligonucleotide base sequences for the MLH1 oligonucleotides of the invention.

TABLE 24

MLH1 Mutations and Genome-Correcting Oligos

| Clinical Phenotype & Mutation | Correcting Oligos | SEQ ID NO: |
|---|---|---|
| Non-polyposis colorectal cancer Met1Arg | TTGGCTGAAGGCACTTCCGTTGAGCATCTAGACGTTTCCTTG GCTCTTCTGGCGCCAAAATGTCGTTCGTGGCAGGGGTTATTC GGCGGCTGGACGAGACAGTGGTGAACCGCATCGCGGC | 2980 |
| ATG-AGG | GCCGCGATGCGGTTCACCACTGTCTCGTCCAGCCGCCGAAT AACCCCTGCCACGAACGACATTTTGGCGCCAGAAGAGCCAA GGAAACGTCTAGATGCTAACGGAAGTGCCTTCAGCCAA | 2981 |
| | CGCCAAAATGTCGTTCG | 2982 |
| | CGAACGACATTTTGGCG | 2983 |
| Non-polyposis colorectal cancer Met1Lys | TTGGCTGAAGGCACTTCCGTTGAGCATCTAGACGTTTCCTTG GCTCTTCTGGCGCCAAAATGTCGTTCGTGGCAGGGGTTATTC GGCGGCTGGACGAGACAGTGGTGAACCGCATCGCGGC | 2984 |
| ATG-AAG | GCCGCGATGCGGTTCACCACTGTCTCGTCCAGCCGCCGAAT AACCCCTGCCACGAACGACATTTTGGCGCCAGAAGAGCCAA GGAAACGTCTAGATGCTAACGGAAGTGCCTTCAGCCAA | 2985 |
| | CGCCAAAATGTCGTTCG | 2986 |
| | CGAACGACATTTTGGCG | 2987 |
| Non-polyposis colorectal cancer Met35Arg | TGGTGAACCGCATCGCGGCGGGGGAAGTTATCCAGCGGCCA GCTAATGCTATCAAAGAGATGATTGAGAACTGGTACGGAGGG AGTCGAGCCGGGCTCACTTAAGGGCTACGACTTAACGG | 2988 |
| ATG-AGG | CCGTTAAGTCGTAGCCCTTAAGTGAGCCCGGCTCGACTCCCT CCGTACCAGTTCTCAATCATCTCTTTGATAGCATTAGCTGGCC GCTGGATAACTTCCCCCGCCGCGATGCGGTTCACCA | 2989 |
| | CAAAGAGATGATTGAGA | 2990 |
| | TCTCAATCATCTCTTTG | 2991 |
| Non-polyposis colorectal cancer Ser44Phe | TAGAGTAGTTGCAGACTGATAAATTATTTTCTGTTTGATTTGCC AGTTTAGATGCTAAAATCCACAAGTATTCAAGTGATTGTTAAAG AGGGAGGCCTGAAGTTGATTCAGATCCAAGACAA | 2992 |
| TCC-TTC | TTGTCTTGGATCTGAATCAACTTGAGGCCTCCCTCTTTAACAA TCACTTGAATACTTGTGGATTTTGCATCTTAAACTGGCAAATCA AACAGAAAATAATTTATCAGTCTGCAACTACTCTA | 2993 |
| | TGCAAAATCCACAAGTA | 2994 |
| | TACTTGTGGATTTTGCA | 2995 |
| Non-polyposis colorectal cancer Gln62Lys | GCAAAATCCACAAGTATTCAAGTGATTGTTAAAGAGGGAGGC CTGAAGTTGATTCAGATCCAAGACAATGGCACCGGGATCAGG GTAAGTAAAACCTCAAAGTAGCAGGATGTTTGTGCGC | 2996 |
| CAA-AAA | GCGCACTAAACATCCTGCTACTTTGAGGTTTTACTTACCCTGAT CCCGGTGCCATTGTCTTGGATCTGAATCAACTTCAGGCCTCC CTCTTTAACAATCACTTGAATACTTGTGGATTTTGC | 2997 |
| | TTCAGATCCAAGACAAT | 2998 |
| | ATTGTCTTGGATCTGAA | 2999 |
| Non-polyposis colorectal cancer Gln62Term | GCAAAATCCACAAGTATTCAAGTGATTGTTAAAGAGGGAGGC CTGAAGTTGATTCAGATCCAAGACAATGGCACCGGGATCAGG GTAAGTAAAACCTCAAAGTAGCAGGATGTTTGTGCGC | 3000 |
| CAA-TAA | GCGCACAAACATCCTGCTACTTTGAGGTTTTACTTACCCTGAT CCCGGTGCCATTGTCTTGGATCTGAATCAACTTCAGGCCTCC CTCTTTAACAATCACTTGAATACTTGTGGATTTTGC | 3001 |
| | TTCAGATCCAAGACAAT | 3002 |
| | ATTGTCTTGGATCTGAA | 3003 |
| Non-polyposis colorectal cancer | CCACAAGTATTCAAGTGATTGTTAAAGAGGGAGGCCTGAAGT TGATTCAGATCCAAGACAATGGCACCGGGATCAGGGTAAGTA | 3004 |

TABLE 24-continued

MLH1 Mutations and Genome-Correcting Oligos

| Clinical Phenotype & Mutation | Correcting Oligos | SEQ ID NO: |
|---|---|---|
| Asn64Ser | AAACCTCAAAGTAGCAGGATGTTTGTGCGCTTCATGG | |
| AAT-AGT | CCATGAAGCGCACAAACATCCTGCTACTTTGAGGTTTTACTTA CCCTGATCCCGGTGCCATTCTCTTGGATCTGAATCAACTTCA GGCCTCCCTCTTTAACAATCACTTGAATACTTGTGG | 3005 |
| | CCAAGACAATGGCACCG | 3006 |
| | CGGTGCCATTGTCTTGG | 3007 |
| Non-polyposis colorectal cancer Gly67Arg | ATTCAAGTGATTGTTAAAGAGGGAGGCCTGAAGTTGATTCAGA TCCAAGACAATGGCACCGGGATCAGGGTAAGTAAAAACCTCAA AGTAGCAGGATGTTTGTGCGCTTCATGGAAGAGTCA | 3008 |
| GGG-AGG | TGACTCTTCCATGAAGCGCACAAACATCCTGCTACTTTGAGGT TTTACTTACCCTGATCCCGGTGCCATTGTCTTGGATCTGAATC AACTTCAGGCCTCCGTCTTTAACAATCACTTGAAT | 3009 |
| | ATGGCACCGGGATCAGG | 3010 |
| | CCTGATCCCGGTGCCAT | 3011 |
| Non-polyposis colorectal cancer Gly67Arg | ATTCAAGTGATTGTTAAAGAGGGAGGCCTGAAGTTGATTCAGA TCCAAGACAATGGCACCGGGATCAGGGTAAGTAAAAACCTCAA AGTAGCAGGATGTTTGTGCGCTTCATGGAAGAGTCA | 3012 |
| GGG-CGG | TGACTCTTCCATGAAGCGCACAAACATCCTGCTACTTTGAGGT TTTACTTACCCTGATCCCGGTGCCATTGTCTTGGATCTGAATC AACTTCAGGCCTCCCTCTTTAACAATCACTTGAAT | 3013 |
| | ATGGCACCGGGATCAGG | 3014 |
| | CCTGATCCCGGTGCCAT | 3015 |
| Non-polyposis colorectal cancer Gly67Trp | ATTCAAGTGATTGTTAAAGAGGGAGGCCTGAAGTTGATTTCAGA TCCAAGACAATGGCACCGGGATCAGGGTAAGTAAAACCTCAA AGTAGCAGGATGTTTGTGCGCTTCATGGAAGAGTCA | 3016 |
| GGG-TGG | TGACTCTTCCATGAAGCGCACAAACATCCTGCTACTTTGAGGT TTTACTTACCCTGATCCCGGTGCCATTGTCTTGGATCTGAATC AACTTCAGGCCTCCCTCTTTAACAATCACTTGAAT | 3017 |
| | ATGGCACCGGGATCAGG | 3018 |
| | CCTGATCCCGGTGCCAT | 3019 |
| Non-polyposis colorectal cancer Cys77Arg | GTAACATGATTATTTACTCATCTTTTGGTATCTAACAGAPAGA AGATCTGGATATTGTATGTGAAAGGTTCACTACTAGTAAACTG CAGTCCTTTGAGGATTTAGCCAGTATTTCTACCT | 3020 |
| TGT-CGT | AGGTAGAAATACTGGCTAAATCCTCAAAGGACTGCAGTTTACT AGTAGTGAACCTTTCACATACAATATCCAGATCTTTCTTTGTT AGATACCAAAAAGATGAGTAAATAATCATGTTAC | 3021 |
| | ATATTGTATGTGAAAGG | 3022 |
| | CCTTTCACATACAATAT | 3023 |
| Non-polyposis colorectal cancer Cys77Tyr | TAACATGATTATTTACTCATCTTTTGGTATCTAACAGAAGAA GATCTGGATATTGTATGTGAAAGGTTCACTACTAGTAAACTGC AGTCCTTTGAGGATTTAGCCAGTATTTCTACCTA | 3024 |
| TGT-TAT | TAGGTAGAAATACTGGCTAAATCCTCAAAGGACTGCAGTTTAC TAGTAGTGAACCTTTCACATACAATATCCAGATCTTCTTTCTGT TAGATACCAAAAAGATGAGTAAATAATCATGTTA | 3025 |
| | TATTGTATGTGAAAGGT | 3026 |
| | ACCTTTCACATACAATA | 3027 |
| Non-polyposis colorectal cancer Ser93Gly | CTGGATATTGTATGTGAAAGGTTCACTACTAGTAAACTGCAGT CCTTTGAGGATTTAGCCAGTATTTCTACCTATGGCTTTCGAGG TGAGGTAAGCTAAAGATTCAAGAAATGTGTAAAAT | 3028 |

TABLE 24-continued

MLH1 Mutations and Genome-Correcting Oligos

| Clinical Phenotype & Mutation | Correcting Oligos | SEQ ID NO: |
|---|---|---|
| AGT-GGT | ATTTTACACATTTCTTGAATCTTTAGCTTACCTCACCTCGAAAG CCATAGGTAGAAATACTGGCTAAATCCTCAAAGGACTGCAGTT TACTAGTAGTGAACCTTTCACATACAATATCCAG | 3029 |
| | ATTTAGCCAGTATTTCT | 3030 |
| | AGAAATACTGGCTAAAT | 3031 |
| Non-polyposis colorectal cancer Arg100Term | TTCACTACTAGTAAACTGCAGTCCTTTGAGGATTTAGCCAGTA TTTCTACCTATGGCTTTCGAGGTGAGGTAAGCTAAAGATTCAA GAAATGTGTAAAATATCCTCCTGTGATGACATTGT | 3032 |
| CGA-TGA | ACAATGTCATCACAGGAGGATATTTTACACATTTCTTGAATCTT TAGCTTACCTCACCTCGAAAGCCATAGGTAGAAATACTGGCTA AATCCTCAAAGGACTGCAGTTTACTAGTAGTGAA | 3033 |
| | ATGGCTTTCGAGGTGAG | 3034 |
| | CTCACCTCGAAAGCCAT | 3035 |
| Non-polyposis colorectal cancer Ile107Arg | ACCCAGCAGTGAGTTTTTCTTTCAGTCTATTTTCTTTTCTTCCT TAGGCTTTGGCCAGCATAAGCCATGTGGCTCATGTTACTATTA CAACGAAAACAGCTGATGGAAAGTGTGCATACAG | 3036 |
| ATA-AGA | CTGTATGCACACTTTCCATCAGCTGTTTTCGTTGTAATAGTAA CATGAGCCACATGGCTTATGCTGGCCAAAGCCTTAGGAAGAA AAGAAAATAGACTGAAAGAAAAACTCACTGCTGGGT | 3037 |
| | GGCCAGCATAAGCCATG | 3038 |
| | CATGGCTTATGCTGGCC | 3039 |
| Non-polyposis colorectal cancer Thr117Arg | TTTCTTTTCTTCCTTAGGCTTTGGCCAGCATAAGCCATGTGGC TCATGTTACTATTACAACGAAAACAGCTGATGGAAAGTGTGCA TACAGGTATAGTGCTGACTTCTTTTACTCATATAT | 3040 |
| ACG-AGG | ATATATGAGTAAAAGAAGTCAGCACTATACCTGTATGCACACT TTCCATCAGCTGTTTTCGTTGTAATAGTAACATGAGCCACATG GCTTATGCTGGCCAAAGCCTAAGGAAGAAAAGAAA | 3041 |
| | TATTACAACGATAAACAG | 3042 |
| | CTGTTTTCGTTGTAATA | 3043 |
| Non-polyposis colorectal cancer Thr117Met | TTTCTTTTCTTCCTTAGGCTTTGGCCAGCATAAGCCATGTGGC TCATGTTACTATTACAACGAAAACAGCTGATGGAAAGTGTGCA TACAGGTATAGTGCTGACTTCTTTTACTCATATAT | 3044 |
| ACG-ATG | ATATATGAGTTAAAAGAAGTCAGCACTATACCTGTATGCACACT TTCCATCAGCTGTTTTCGTTGTAATAGTAACATGAGCCACATG GCTTATGCTGGCCAAAGCGTAAGGAAGAAAAGAAA | 3045 |
| | TATTACAACGAAAACAG | 3046 |
| | CTGTTTTCGTTGTAATA | 3047 |
| Non-polyposis colorectal cancer Gly133Term | TCTATCTCTCTACTGGATATTAATTTGTTATATTTTCTCATTAGA GCAAGTTACTCAGATGGAAAACTGAAAGCCCCTCCTAAACCA TGTGCTGGCAATCAAGGGACCCAGATCACGGTAA | 3048 |
| GGA-TGA | TTACCGTGATCTGGGTCCCTTGATTGCCAGCACATGGTTTAG GAGGGGCTTTCAGTTTTCCATCTGAGTAACTTGCTCTAATGAG ATAAATATAACAAATTAATATCCAGTAGAGAGATAGA | 3049 |
| | ACTCAGATGGAAAACTG | 3050 |
| | CAGTTTTCCATCTGAGT | 3051 |
| Non-polyposis colorectal cancer Val185Gly | TAGTGTGTGTTTTTGGCAACTCTTTTCTTACTCTTTTGTTTTTC TTTTCCAGGTATTCAGTACACAATGCAGGCATTAGTTTTCTCAG TTAAAAAAGTAAGTTCTTGGTTTATGGGGGATGG | 3052 |
| GTA-GGA | CCATCCCCCATAAACCAAGAAGTTACTTTTTTAACTGAGAAAC TAATGCCTGCATTGTGTACTGAATACCTGGAAAAGAATAAACAA | 3053 |

TABLE 24-continued

MLH1 Mutations and Genome-Correcting Oligos

| Clinical Phenotype & Mutation | Correcting Oligos | SEQ ID NO: |
|---|---|---|
| | AAGAGTAAGTAAAAGAGTTGCCAAAAACACACACTA | |
| | GTATTCAGTACACAATG | 3054 |
| | CATTGTGTACTGAATAC | 3055 |
| Non-polyposis colorectal cancer Ser193Pro | TTTCTTACTCTTTTGTTTTTCTTTTCCAGGTATTCAGTACACAAT GCAGGCATTAGTTTCTCAGTTAAAAAAGTAAGTTCTTGGTTTAT GGGGGATGGTTTTGTTTTATGTAAAAGAAAAAA | 3056 |
| TCA-CCA | TTTTTTCTTTTCATAAAACAAAACCATCCCCCATAAACCAAGAA CTTACTTTTTTAACTGAGAAACTAATGCCTGCATTGTGTACTG AATACCTGGAAAAGAAAAACAAAAGAGTAAGAAA | 3057 |
| | TTAGTTTCTCAGTTAAA | 3058 |
| | TTTAACTGAGAAACTAA | 3059 |
| Non-polyposis colorectal cancer | TTTGTTTATCAGCTAGGAGAGACAGTAGCTGATGTTAGGACA CTACCCAATGCCTCAACCGTGGACAATATTCGCTCCATCTTTG GAAATGCTGTTAGTCGGTATGTCGATAACCTATATA | 3060 |
| | TATATAGGTTATCGACATACCGACTAACAGCATTTCCAAAGAT GGAGCGAATATTGTCCACGGTTGAGGCATTGGGTAGTGTCCT AACATCAGCTACTGTCTCTCCTTGCTGATAAACAAA | 3061 |
| | CCTCAACCGTGGACAAT | 3062 |
| | ATTGTCCACGGTTGAGG | 3063 |
| Non-polyposis colorectal cancer Arg217Cys | CAAGGAGAGACAGTAGCTGATGTTAGGACACTACCCAATGCC TCAACCGTGGACAATATTCGCTCCATCTTTGGAAATGCTGTTA GTCGGTATGTCGATAACCTATATAAAAAAAATCTTTT | 3064 |
| CGC-TGC | AAAAGATTTTTTTATATAGGTTATCGACATACCGACTAACAGCA TTTCCAAAGATGGAGCGAATATTGTCCACGGTTGAGGCATTG GGTAGTGTCCTAACATCAGCTACTGTCTCTCCTTG | 3065 |
| | ACAATATTCGCTCCATC | 3066 |
| | GATGGAGCGAATATTGT | 3067 |
| Non-polyposis colorectal cancer Ile219Val | GAGACAGTAGCTGATGTTAGGACACTACCCAATGCCTCAACC GTGGACAATATTCGCTCCATCTTTGGAAATGCTGTTAGTCGGT ATGTCGATAACCTATATAAAAAAATCTTTTACATTT | 3068 |
| ATC-GTC | AAATGTAAAAGATTTTTTTATATAGGTTATCGACATACCGACTA ACAGCATTTCCAAAGATGGAGCGAATATTGTCCACGGTTGAG GCATTGGGTAGTGTCCTAACATCAGCTACTGTCTC | 3069 |
| | TTCGCTCCATCTTTGGA | 3070 |
| | TCCAAAGATGGAGCGAA | 3071 |
| Non-polyposis colorectal cancer Gly244Asp | CTAATAGAGAACTGATAGTAAATTGGATGTGAGGATAAAACCCT AGCCTTCAAAATGAATGGTTACATATCCAATGCAAACTACTCA GTGAAGAAGTGCATCTTCTTACTCTTCATCAACCG | 3072 |
| GGT-GAT | CGGTTGATGAAGAGTAAGAAGATGCACTTCTTCACTGAGTAG TTTGCATTGGATATGTAACCATTCATTTTGAAGGCTAGGGTT TATCCTCACATCCAATTTCTATCAGTTCTCTATTAG | 3073 |
| | AATGAATGGTTACATAT | 3074 |
| | ATATGTAACCATTCATT | 3075 |
| Non-polyposis colorectal cancer Ser252Term | GATGTGAGGATAAAACCCTAGCCTTCAAPATGAATGGTTACAT ATCCAATGCAAACTACTCAGTGAAGAAGTGCATCTCTTACTC TTCATCAACCGTAAGTTAAAAAGAACCACATGGGA | 3076 |
| TCA-TAA | TCCCATGTGGTTCTTTTTAACTTACGGTTGATGAAGAGTAAGA AGATGCACTTCTTCACTGAGTAGTTTGCATTGGATATGTAACC ATTCATTTTGAAGGCTAGGGTTTTATCCTCACATC | 3077 |

TABLE 24-continued

MLH1 Mutations and Genome-Correcting Oligos

| Clinical Phenotype & Mutation | Correcting Oligos | SEQ ID NO: |
|---|---|---|
| | AAACTACTCAGTGAAGA | 3078 |
| | TCTTCACTGAGTAGTTT | 3079 |
| Non-polyposis colorectal cancer Glu268Gly | CACCCCTCAGGACAGTTTTGAACTGGTTGCTTTCTTTTTATTG TTTAGATCGTCTGGTAGAATCAACTTCCTTGAGAAAAGCCATA GAAACAGTGTATGCAGCCTATTTGCCCAAAAACAC | 3080 |
| GAA-GGA | GTGTTTTTGGGCAAATAGGCTGCATACACTGTTTCTATGGCTT TTCTCAAGGAAGTTGATTCTACCAGACGATCTAAACAATAAAA AGAAAGCAACCAGTTCAAAACTGTCCTGAGGGGTG | 3081 |
| | TCTGGTAGAATCAACTT | 3082 |
| | AAGTTGATTCTACCAGA | 3083 |
| Non-polyposis colorectal cancer Ser269Term | CCCTCAGGACAGTTTTGAACTGGTTGCTTTCTTTTTATTGTTTA GATCGTCTGGTAGAATCAACTTCCTTGAGTAAAGCCATAGAAA CAGTGTATGCAGCCTATTTGCCCAAAAACACACA | 3084 |
| TCA-TGA | TGTGTGTTTTTGGGCAAATAGGCTGCATACACTGTTTCTATGG CTTTTCTCAAGGAAGTTGATTCTACCAGACGATCTAAACAATA AAAGAAAGCAACCAGTTCAAAACTGTCCTGAGGG | 3085 |
| | GGTAGAATCAACTTCCT | 3086 |
| | AGGAAGTTGATTCTACC | 3087 |
| Non-polyposis colorectal cancer Glu297Term | CTTTTTCTCCCCCTCCCACTATCTAAGGTAATTGTTCTCTCTTA TTTTCCTGACAGTTTAGAAATCAGTCCCCAGAATGTGGATGTT AATGTGCACCCCACTAAAGCATGAAGTTCACTTCC | 3088 |
| GAA-TAA | GGAAGTGAACTTCATGCTTTGTGGGGTGCACATTAACATCCA CATTCTGGGGACTGATTTCTAAACTGTCAGGAAAATAAGAGAG AACAATTACCTTAGATAGTGGGAGGGGGAGAAAAAG | 3089 |
| | ACAGTTTAGAAATCAGT | 3090 |
| | ACTGATTTCTAAACTGT | 3091 |
| Non-polyposis colorectal cancer Gln301Term | CTCCCACTATCTAAGGTAATTGTTCTCTCTTATTTTCCTGACAG TTTAGAAATCAGTCCCCAGAATGTGGATGTTAATGTGCACCCC ACAAAGCATGAAGTTCACTTCCTGCACGAGGAGA | 3092 |
| CAG-TAG | TCTCCTCGTGCAGGAAGTGAACTTCATGCTTTGTGGGGTGCA CATTAACATCCACATTCTGGGGACTGATTTCTAAACTGTCAGG AAAATAAGAGAGAACAATTACCTTAGATAGTGGGAG | 3093 |
| | TCAGTCCCCAGAATGTG | 3094 |
| | CACATTCTGGGGACTGA | 3095 |
| Non-polyposis colorectal cancer Val326Ala | ATGTGCACCCCACAAAGCATGAAGTTCACTTCGTGCACGAGG AGAGCATCCTGGAGCGGGTGCAGCAGCACATCGAGAGCAAG CTCCTGGGCTCCAATTCCTCCAGGATGTACTTCACCCA | 3096 |
| GTG-GCG | TGGGTGAAGTACATCCTGGAGGAATTGGAGCCCAGGAGCTT GCTCTCGATGTGCTGCTGCACCCGCTCCAGGATGCTCTCCT CGTGCAGGAAGTGAACTTCATGCTTTGTGGGGTGCACAT | 3097 |
| | GGAGCGGGTGCAGCAGC | 3098 |
| | GCTGCTGCACCCGCTCC | 3099 |
| Non-polyposis colorectal cancer His329Pro | CCACAAAGCATGAAGTTCACTTCCTGCACGAGGAGAGCATCC TGGAGCGGGTGCAGCAGCACATCGAGAGCAAGCTCCTGGGC TCCAATTCCTCCAGGATGTACTTCACCCAGGTCAGGGC | 3100 |
| CAC-CCC | GCCCTGACCTGGGTGAAGTACATCCTGGAGGAATTGGAGCC CAGGAGCTTGCTCTCGATGTGCTGCTGCACCCGCTCCAGGA TGCTCTCCTCGTGCAGGAAGTGAACTTCATGCTTTGTGG | 3101 |

TABLE 24-continued

MLH1 Mutations and Genome-Correcting Oligos

| Clinical Phenotype & Mutation | Correcting Oligos | SEQ ID NO: |
|---|---|---|
| | GCAGCAGCACATCGAGA | 3102 |
| | TCTCGATGTGCTGCTGC | 3103 |
| Non-polyposis colorectal cancer Val384Asp | CAAGTCTGACCTCGTCTTCTACTTCTGGAAGTAGTGATAAGGT CTATGCCCACCAGATGGTTCGTACAGATTCCCGGGAACAGAA GCTTGATGCATTTCTGCAGCCTCTGAGCAAACCCCT | 3104 |
| GTT-GAT | AGGGGTTTGCTCAGAGGCTGCAGAAATGCATCAAGCTTCTGT TCCCGGGAATCTGTACGAACCATCTGGTGGGCATAGACCTTA TCACTACTTCCAGAAGTAGAAGACGAGGTCAGACTTG | 3105 |
| | CCAGATGGTTCGTACAG | 3106 |
| | CTGTACGAACCATCTGG | 3107 |
| Non-polyposis colorectal cancer Ala441Thr | AGTGGCAGGGCTAGGCAGCAAGATGAGGAGATGCTTGAACT CCCAGCCCCTGCTGAAGTGGCTGCCAAAAATCAGAGCTTGGA GGGGGATACAACAAAGGGGACTTCAGAAATGTCAGAGA | 3108 |
| GCT-ACT | TCTCTGACATTTCTGAAGTCCCCTTTGTTGTATCCCCCTCCAA GCTCTGATTTTTGGCAGCCACTTCAGCAGGGGCTGGGAGTTC AAGCATCTCCTCATCTTGCTGCCTAGCCCTGCCACT | 3109 |
| | CTGAAGTGGCTGCCAAA | 3110 |
| | TTTGGCAGCCACTTCAG | 3111 |
| Non-polyposis colorectal cancer Arg487Term | CTTCATTGCAGAAAGAGACATCGGGAAGATTCTGATGTGGAA ATGGTGGAAGATGATTCCCGAAAGGAAATGACTGCAGCTTGT ACCCCCCGGAGAAGGATCATTAACCTCACTAGTGTTT | 3112 |
| CGA-TGA | AAACACTAGTGAGGTTAATGATCCTTCTCCGGGGGTACAAG CTGCAGTCATTTCCTTTCGGGAATCATCTTCCACCATTTCCAC ATCAGAATCTTCCCGATGTCTCTTTCTGCAATGAAG | 3113 |
| | ATGATTCCCGTAAAGGAA | 3114 |
| | TTCCTTTCGGGAATCAT | 3115 |
| Non-polyposis colorectal cancer Ala492Thr | AGACATCGGGAAGATTCTGATGTGGAAATGGTGGAAGATGAT TCCCGAAAGGAAATGACTGCAGCTTGTACCCCCCGGAGAAG GATCATTAACCTCACTAGTGTTTTGAGTCTCCAGGAAG | 3116 |
| GCA-ACA | CTTCCTGGAGACTCAAAACACTAGTGAGGTTAATGATCCTTCT CCGGGGGGTACAAGCTGCAGTCATTTCCTTTCGGGAATCATC TTCCACCATTTCCACATCAGAATCTTCCCGATGTCT | 3117 |
| | AAATGACTGCAGCTTGT | 3118 |
| | ACAAGCTGCAGTCATTT | 3119 |
| Non-polyposis colorectal cancer Val506Ala | CCCGAAAGGAAATGACTGCAGCTTGTACCCCCCGGAGAAGG ATCATTAACCTCACTAGTGTTTTGAGTCTCCAGGAAGAAATTA ATGAGCAGGGACATGAGGGTACGTAAACGCTGTGGCC | 3120 |
| GTT-GCT | GGCCACAGCGTTTACGTACCCTCATGTCCCTGCTCATTAATTT CTTCCTGGAGACTCAAAACACTAGTGAGGTTAATGATCCTTCT CCGGGGGGTACAAGCTGCAGTCATTTCCTTTCGGG | 3121 |
| | CACTAGTGTTTTGAGTC | 3122 |
| | GACTCAAAACACTAGTG | 3123 |
| Non-polyposis colorectal cancer Gln542Leu | GGGAGATGTTGCATAACCACTCCTTCGTGGGCTGTGTGTGAATC CTCAGTGGGCCTTGGCACAGCATCAAACCAAGTTATACCTTCT TTCAACACCACCAAGCTTAGGTAAATCAGCTGAGTGTG | 3124 |
| CAG-CTG | CACACTCAGCTGATTTACCTAAGCTTGGTGGTGTTGAGAAGG TATAACTTGGTTTGATGCTGTGCCAAGGCCCACTGAGGATTC ACACAGCCCACGTAGGAGTGGTTATGCTACATCTCCC | 3125 |

TABLE 24-continued

MLH1 Mutations and Genome-Correcting Oligos

| Clinical Phenotype & Mutation | Correcting Oligos | SEQ ID NO: |
|---|---|---|
| | CTTGGCACAGCATCAAA | 3126 |
| | TTTGATGCTGTGCCAAG | 3127 |
| Non-polyposis colorectal cancer Leu549Pro | CCTTCGTGGGCTGTGTGAATCCTCAGTGGGCCTTGGCACAG CATCAAACCAAGTTATACCTTCTCAACACCACCAAGCTTAGGT AAATCAGCTGAGTGTGTGAACAAGCAGAGCTACTACA | 3128 |
| CTT-CCT | TGTAGTAGCTCTGCTTGTTCACACACTCAGCTGATTTACCTAA GCTTGGTGGTGTTGAGAAGGTATAACTTGGTTTGATGCTGTG CCAAGGCCCACTGAGGATTCACACAGCCCACGAAGG | 3129 |
| | GTTATACCTTCTCAACA | 3130 |
| | TGTTGAGAAGGTATAAC | 3131 |
| Non-polyposis colorectal cancer Asn551Thr | TGGGCTGTGTGAATCCTCAGTGGGCCTTGGCACAGCATCAAA CCAAGTTATACCTTCTCAACACCACCAAGCTTAGGTAAATCAG CTGAGTGTGTGAACAAGCAGAGCTACTACAACAATG | 3132 |
| AAC-ACC | CATTGTTGTAGTAGCTCTGCTTGTTCACACACTCAGCTGATTT ACCTAAGCTTGGTGGTGTTGAGAAGGTATAACTTGGTTTGATG CTGTGCCAAGGCCCACTGAGGATTCACACAGCCCA | 3133 |
| | CCTTCTCAACACCACCA | 3134 |
| | TGGTGGTGTTGAGAAGG | 3135 |
| Non-polyposis colorectal cancer Gln562Term | ATGAATTCAGCTTTTCCTTAAAGTCACTTCATTTTTATTTTCAG TGAAGAACTGTTCTACCAGATACTCATTTATGATTTTGCCAATT TTGGTGTTCTCAGGTTATCGGTAAGTTTAGATC | 3136 |
| CAG-TAG | GATCTAAACTTACCGATAACCTGAGAACACCAAAATTGGCAAA ATCATAAATGAGTATCTGGTAGAACAGTTCTTCACTGAAAATA AAAATGAAGTGACTTTAAGGAAAAGCTGAATTCAT | 3137 |
| | TGTTCTACCAGATACTC | 3138 |
| | GAGTATCTGGTAGAACA | 3139 |
| Non-polyposis colorectal cancer Ile565Phe | GCTTTTCCTTAAAGTCACTTCATTTTTATTTTCAGTGAAGAACT GTTCTACCAGATACTCATTTATGATTTTGCCAATTTTGGTGTTC TCAGGTTATCGGTAAGTTTAGATCCTTTTCACT | 3140 |
| ATT-TTT | AGTGAAAAGGATCTAAACTTACCGATAACCTGAGAACACCAAA ATTGGCAAAATCATAAATGAGTATCTGGTAGAACAGTTCTTCA CTGAAAATAAAAATGAAGTGACTTTAAGGAAAAGC | 3141 |
| | AGATACTCATTTATGAT | 3142 |
| | ATCATAAATGAGTATCT | 3143 |
| Non-polyposis colorectal cancer Leu574Pro | TTTTCAGTGAAGAACTGTTCTACCAGATACTCATTTATGATTTT GCCAATTTTGGTGTTCTCAGGTTATCGGTAAGTTTAGATCCTT TTCACTTCTGAAATTTCAACTGATCGTTTCTGAA | 3144 |
| CTC-CCC | TTCAGAAACGATCAGTTGAAATTTCAGAAGTGAAAAGGATCTA AACTTACCGATAACCTGAGAACACCAAAATTGGCAAAATCATA AATGAGTATCTGGTAGAACAGTTCTTCACTGAAAA | 3145 |
| | TGGTGTTCTCAGGTTAT | 3146 |
| | ATAACCTGAGAACACCA | 3147 |
| Non-polyposis colorectal cancer Leu582Val | TGGATGCTCCGTTTAAAGCTTGCTCCTCATGTTCTTGCTTCTT CCTAGGAGCCAGCACCGCTCTTTGACCTTGCCATGCTTGCCT TAGATAGTCCAGAGAGTGGCTGGACAGAGGAAGATG | 3148 |
| CTC-GTC | CATCTTCCTCTGTCCAGCCACTCTCTGGACTATCTAAGGCAA GCATGGCAAGGTCAAAGAGCGGTGCTGGCTCCTAGGAAGAA GCAAGAACATGAAGGAGCAAGCTTTAACGGAGCATCCA | 3149 |

TABLE 24-continued

MLH1 Mutations and Genome-Correcting Oligos

| Clinical Phenotype & Mutation | Correcting Oligos | SEQ ID NO: |
|---|---|---|
| | CAGCACCGCTCTTTGAC | 3150 |
| | GTCAAAGAGCGGTGCTG | 3151 |
| Non-polyposis colorectal cancer Leu607His | TGCTTGCCTTAGATAGTCCAGAGAGTGGCTGGACAGAGGAAG ATGGTCCCAAAGAAGGACTTGCTGAATACATTGTTGAGTTTCT GAAGAAGAAGGCTGAGATGCTTGCAGACTATTTCTC | 3152 |
| CTT-CAT | GAGAAATAGTCTGCAAGCATCTCAGCCTTCTTCTTCAGAAACT CAACAATGTATTCAGCAAGTCCTTCTTTGGGACCATCTTCCTC TGTCCAGCCACTCTCTGGACTATCTAAGGCAAGCA | 3153 |
| | AGAAGGACTTGCTGAAT | 3154 |
| | ATTCAGCAAGTCCTTCT | 3155 |
| Non-polyposis colorectal cancer Lys618Term | ACAGAGGAAGATGGTCCCAAAGAAGGACTTGCTGAATACATT GTTGAGTTTCTGAAGAAGAAGGCTGAGATGCTTGCAGACTAT TTCTCTTTGGAAATTGATGAGGTGTGACAGCCATTCT | 3156 |
| AAG-TAG | AGTATGGCTGTCACACCTCATCAATTTCCAAAGAGAAATAGTC TGCAAGCATCTCAGCCTTCTTCTTCAGAAACTCAACAATGTAT TCAGCAAGTCCTTCTTTGGGACCATCTTCCTCTGT | 3157 |
| | TGAAGAAGAAGGCTGAG | 3158 |
| | CTCAGCCTTCTTCTTCA | 3159 |
| Non-polyposis colorectal cancer Lys618Thr | CAGAGGAAGATGGTCCCAAAGAAGGACTTGCTGAATACATTG TTGAGTTTCTGAAGAAGAAGGCTGAGATGCTTGCAGACTATTT CTCTTTGGAAATTGATGAGGTGTGACAGCCATTCTT | 3160 |
| AAG-ACG | AAGAATGGCTGTCACACCTCATCAATTTCCAAAGAGAAATAGT CTGCAAGCATCTCAGCCTTCTTCTTCAGAAACTCAACAATGTA TTCAGCAAGTCCTTCTTTGGGACCATCTTCCTCTG | 3161 |
| | GAAGAAGAAGGCTGAGA | 3162 |
| | TCTCAGCCTTCTTCTTC | 3163 |
| Non-polyposis colorectal cancer Arg659Leu | TACCCCTTCTGATTGACAACTATGTGCCCCCTTTGGAGGGAC TGCCTATCTTCATTCTTCGACTAGCCACTGAGGTCAGTGATCA AGCAGATACTAAGCATTTCGGTACATGCATGTGTGC | 3164 |
| CGA-CTA | GCACACATGCATGTACCGAAATGCTTAGTATCTGCTTGATCAC TGACCTCAGTGGCTAGTCGAAGAATGAAGATAGGCAGTCCCT CCAAAGGGGGCACATAGTTGTCAATCAGAAGGGGTA | 3165 |
| | CATTCTTCGACTAGCCA | 3166 |
| | TGGCTAGTCGAAGAATG | 3167 |
| Non-polyposis colorectal cancer Arg659Pro | TACCCCTTCTGATTGACAACTATGTGCCCCCTTTGGAGGGAC TGCCTATCTTCATTCTTCGACTAGCCACTGAGGTCAGTGATCA AGCAGATACTAAGCATTTCGGTACATGCATGTGTGC | 3168 |
| CGA-CCA | GCACACATGCATGTACCGAAATGCTTAGTATCTGCTTGATCAC TGACGTCAGTGGCTAGTCGAAGAATGAAGATAGGCAGTCCCT CCTAAAGGGGGCACATAGTTGTCAATCAGAAGGGGTA | 3169 |
| | CATTCTTCGACTAGCCA | 3170 |
| | TGGCTAGTCGAAGAATG | 3171 |
| Non-polyposis colorectal cancer Arg659Term | TTACCCCTTCTGATTGACAACTATGTGCCCCCTTTGGAGGGA CTGCCTATCTTCATTCTTCGACTAGCCACTGAGGTCAGTGATC AAGCAGATACTAAGCATTTCGGTACATGCATGTGTG | 3172 |
| CGA-TGA | CACACATGCATGTACCGAAATGCTTAGTATCTGCTTGATCACT GACCTCAGTGGCTAGTCGAAGAATGAAGATAGGCAGTCCCTC CAAAGGGGGCACATAGTTGTCAATCAGAAGGGGTAA | 3173 |

TABLE 24-continued

MLH1 Mutations and Genome-Correcting Oligos

| Clinical Phenotype & Mutation | Correcting Oligos | SEQ ID NO: |
|---|---|---|
| | TCATTCTTCGACTAGCC | 3174 |
| | GGCTAGTCGAAGAATGA | 3175 |
| Non-polyposis colorectal cancer Ala681Thr | TTGGACCAGGTGAATTGGGACGAAGAAAAGGAATGTTTTGAA AGCCTCAGTAAAGAATGCGCTATGTTCTATTCCATCCGGAAG CAGTACATATCTGAGGAGTCGACCCTCTCAGGCCAGC | 3176 |
| GCT-ACT | GCTGGCCTGAGAGGGTCGACTCCTCAGATATGTACTGCTTCC GGATGGAATAGAACATAGCGCATTCTTTACTGAGGCTTTCAAA ACATTCCTTTTCTTCGTCCCAATTCACCTGGTCCAA | 3177 |
| | AAGAATGCGCTATGTTC | 3178 |
| | GAACATAGCGCATTCTT | 3179 |
| Non-polyposis colorectal cancer Trp712Term | AGGCTTATGACATCTAATGTGTTTTCCAGAGTGAAGTGCCTGG CTCCATTCCPAACTCCTGGAAGTGGACTGTGGAACACATTGT CTATAAAGCCTTGCGCTCACACATTCTGCCTCCTAA | 3180 |
| TGG-TAG | TTAGGAGGCAGAATGTGTGAGCGCAAGGCTTTATAGACAATG TGTTCCACAGTCCACTTCCAGGAGTTTGGAATGGAGCCAGGC ACTTCACTCTGGAAAACACATTAGATGTCATAAGCCT | 3181 |
| | AAACTCCTGGAAGTGGA | 3182 |
| | TCCACTTCCAGGAGTTT | 3183 |
| Non-polyposis colorectal cancer Trp714Term | ATGACATCTAATGTGTTTTCCAGAGTGAAGTGCCTGGCTCCAT TCCAAACTCCTGGAAGTGGACTGTGGAACACATTGTCTATAAA GCCTTGCGCTCACACATTCTGCCTCCTAAACATTT | 3184 |
| TGG-TAG | AAATGTTTAGGAGGCAGAATGTGTGAGCGCAAGGCTTTATAG ACAATGTGTTCCACAGTCCACTTCCAGGAGTTTGGAATGGAG CCAGGCACTTCACTCTGGAAAACACATTAGATGTCAT | 3185 |
| | CTGGAAGTGGACTGTGG | 3186 |
| | CCACAGTCCACTTCCAG | 3187 |
| Non-polyposis colorectal cancer Trp714Term | TGACATCTAATGTGTTTTCCAGAGTGAAGTGCCTGGCTCCATT CCAAACTCCTGGAAGTGGACTGTGGAACACATTGTCTATAAA GCCTTGCGCTCACACATTCTGCCTCCTAAACATTTC | 3188 |
| TGG-TGA | GAAATGTTTAGGAGGCAGAATGTGTGAGCGCAAGGCTTTATA GACAATGTGTTCCACAGTCCACTTCCAGGAGTTTGGAATGGA GCCAGGCACTTCACTCTGGAAkACACATTAGATGTCA | 3189 |
| | TGGAAGTGGACTGTGGA | 3190 |
| | TCCACAGTCCACTTCCA | 3191 |
| Non-polyposis colorectal cancer Val716Met | ATCTAATGTGTTTTCCAGAGTGAAGTGCCTGGCTCCATTCCAA ACTCCTGGAAGTGGACTGTGGAACACATTGTCTATAAAGCCTT GCGCTCACACATTCTGCCTCCTAAACATTTCACAG | 3192 |
| GTG-ATG | CTGTGAAATGTTTAGGAGGCAGAATGTGTGAGCGCAAGGCTT TATAGACAATGTGTTCCACAGTCCACTTCCAGGAGTTTGGAAT GGAGCCAGGCACTTCACTCTGGAAAACACATTAGAT | 3193 |
| | AGTGGACTGTGGAACAC | 3194 |
| | GTGTTCCACAGTCCACT | 3195 |
| Non-polyposis colorectal cancer Tyr721Term | GAGTGAAGTGCCTGGCTCCATTCCAAACTCCTGGAAGTGGAC TGTGGAACACATTGTCTATAAAGCCTTGCGCTCACACATTCTG CCTCCTAAACATTTCACAGAAGATGGAAATATCCTG | 3196 |
| TAT-TAA | CAGGATATTTCCATCTTCTGTGAAATGTTTAGGAGGCAGAATG TGTAGCGCAAGGCTTTATAGACAATGTGTTCCACAGTCCAC TTCCAGGAGTTTGGAATGGAGCCAGGCACTTCACTC | 3197 |

TABLE 24-continued

MLH1 Mutations and Genome-Correcting Oligos

| Clinical Phenotype & Mutation | Correcting Oligos | SEQ ID NO: |
|---|---|---|
| | ATTGTCTATAAAGCCTT | 3198 |
| | AAGGCTTTATAGACAAT | 3199 |
| Non-polyposis colorectal cancer Lys751Arg | CTAAACATTTCACAGAAGATGGAAATATCCTGCAGCTTGCTAA CCTGCCTGATCTATACAAAGTCTTTGAGAGGTGTTAAATATGG TTATTTATGCACTGTGGGATGTGTTCTTCTTTCTC | 3200 |
| AAA-AGA | GAGTAAGAAGAACACATCCCACAGTGCATAAATAACCATATTT AACACCTCTCAAAGACTTTGTATAGATCAGGCAGGTTAGCAAG CTGCAGGATATTTCCATCTTCTGTGAAATGTTTAG | 3201 |
| | TCTATACAAAGTCTTTG | 3202 |
| | CAAAGACTTTGTATAGA | 3203 |
| Non-polyposis colorectal cancer Arg755Trp | ACAGAAGATGGAAATATCCTGCAGCTTGCTAACCTGCCTGAT CTATACAAAGTCTTTGAGAGGTGTTAAATATGGTTATTTATGCA CTGTGGGATGTGTTCTTCTTTCTCTGTATTCCGAT | 3204 |
| AGG-TGG | ATCGGAATACAGAGAAAGAAGAACACATCCCAGAGTGCATAA ATAACCATATTTAACACCTCTCAAAGACTTTGTATAGATCAGG CAGGTTAGCAAGCTGCAGGATATTTCCATCTTCTGT | 3205 |
| | TCTTTGAGAGGTGTTAA | 3206 |
| | TTAACACCTCTCAAAGA | 3207 |

EXAMPLE 18

Human Mismatch Repair—MSH2

The human MSH2 gene is homologous to the bacterial mutS gene, which is involved in mismatch repair. Mutations in the MSH2 gene have been identified in a variety of cancers, including, for example, ovarian tumors, colorectal cancer, endometrial cancer, uterine cancer. The attached table discloses the correcting oligonucleotide base sequences for the MSH2 oligonucleotides of the invention.

TABLE 25

MSH2 Mutations and Genome-Connecting Oligos

| Clinical Phenotype & Mutation | Correcting Oligos | SEQ ID NO: |
|---|---|---|
| Non polyposis colorectal cancer Gln252Term | TTTTCCACAAAAGACATTTATCAGGACCTCAACCGGTTGTTGA AAGGCAAAAAGGGAGAGCAGATGAATAGTGCTGTATTGCCAG AAATGGAGAATCAGGTACATGGATTATAAATGTGAA | 3208 |
| CAG-TAG | TTCACATTTATAATCCATGTACCTGATTCTCCATTTCTGGCAAT ACAGCACTATTCATCTGCTCTCCCTTTTTGCCTTTCAACAACC GGTTGAGGTCCTGATAAATGTCTTTTGTGGAAAA | 3209 |
| | AGGGAGAGCAGATGAAT | 3210 |
| | ATTCATCTGCTCTCCCT | 3211 |
| Non polyposis colorectal cancer Gln288Term | TCATCACTGTCTGCGGTAATCAAGTTTTTAGAACTCTTATCAG ATGATTCCAACTTTGGACAGTTTGAACTGACTACTTTTGACTT CAGCCAGTATATGAAATTGGATATTGCAGCAGTCA | 3212 |
| CAG-TAG | TGACTGCTGCAATATCCAATTTCATATACTGGCTGAAGTCAAA AGTAGTCAGTTCAAACTGTCCAAAGTTGGAATCATCTGATAAG AGTTCTAAAAACTTGATTACCGCAGACAGTGATGA | 3213 |

TABLE 25-continued

MSH2 Mutations and Genome-Connecting Oligos

| Clinical Phenotype & Mutation | Correcting Oligos | SEQ ID NO: |
|---|---|---|
| | ACTTTGGACAGTTTGAA | 3214 |
| | TTCAAACTGTCCAAAGT | 3215 |
| Non polyposis colorectal cancer Ala305Thr | AACTTTGGACAGTTTGAACTGACTACTTTTGACTTCAGCCAGT ATATGAAATTGGATATTGCAGCAGTCAGAGCCCTTAACCTTTT TCAGGTAAAAAAAAAAAAAAAAAAAAAAAAAAAAAGG | 3216 |
| GCA-ACA | CCTTTTTTTTTTTTTTTTTTTTTTTTACCTGAAAAAGGTTAAG GGCTCTGACTGCTGCAATATCCAATTTCATATACTGGCTGAAG TCAAAAGTAGTCAGTTCAAACTGTCCAAAGTT | 3217 |
| | TGGATATTGCAGGAGTC | 3218 |
| | GACTGCTGCAATATCCA | 3219 |
| Non polyposis colorectal cancer Gly322Asp | AGCTTGCCATTCTTTCTATTTTATTTTTTGTTTACTAGGGTTCT GTTGAAGATACCACTGGCTCTCAGTCTCTGGCTGCCTTGCTG AATAAGTGTAAAACCCCTCAAGGACAAAGACTTGT | 3220 |
| GGC-GAC | ACAAGTCTTTGTCCTTGAGGGGTTTTACACTTATTCAGCAAGG CAGCCAGAGACTGAGAGCCAGTGGTATCTTCAACAGAACCCT AGTAAACAAAAAATAAAATAGAAAGAATGGCAAGCT | 3221 |
| | TACCACTGGCTCTCAGT | 3222 |
| | ACTGAGAGCCAGTGGTA | 3223 |
| Non polyposis colorectal cancer Ser323Cys | TTGCCATTCTTTCTATTTTATTTTTTGTTTACTAGGGTTCTGTTG AAGATACCACTGGCTCTCAGTCTGTGGCTGGCTTGCTGAATA AGTGTAAAACCCCTCAAGGACAAAGACTTGTTAA | 3224 |
| TCT-TGT | TTAACAAGTCTTTGTCCTTGAGGGGTTTTACACTTATTCAGCA AGGCAGCCAGAGACTGAGAGCCAGTGGTATCTTCAACAGAAC CCTAGTAAACAAAAAATAAAATAGAAAGAATGGCAA | 3225 |
| | CACTGGCTCTCAGTCTC | 3226 |
| | GAGACTGAGAGCCAGTG | 3227 |
| Non polyposis colorectal cancer Arg383Term | GTGGAAGCTTTTGTAGAAGATGCAGAATGAGGCAGACTTTA CAAGAAGATTTACTTCGTCGATTCGCAGATCTTAACCGACTTG CCAAGAAGTTTCAAAGACAAGCAGCAAACTTACAAG | 3228 |
| CGA-TGA | CTTGTAAGTTTGCTGCTTGTCTTTGAAACTTCTTGGCAAGTCG GTTAAGATCTGGGAATCGACGAAGTAAATCTTCTTGTAAAGTC TGCCTCAATTCTGCATCTTCTACAAAAGCTTCCAC | 3229 |
| | TACTTCGTCGATTCCCA | 3230 |
| | TGGGAATCGACGAAGTA | 3231 |
| Non polyposis colorectal cancer Gln397Term | CAAGAAGATTTACTTCGTCGATTCCCAGATCTTAACCGACTTG CCAAGAAGTTTCAAAGACAAGCAGCAAACTTACAAGATTGTTA CCGACTCTATCAGGGTATAAAATCAACTACCTAATG | 3232 |
| CAA-TAA | CATTAGGTAGTTGATTTATACCCTGATAGAGTCGGTAACAATC TTGTAAGTTTGCTGCTTGTCTTTGAAACTTCTTGGCAAGTCGG TTAAGATCTGGGAATCGACGAAGTAAATCTTCTTG | 3233 |
| | TTCAAAGACAAGCAGCA | 3234 |
| | TGCTGCTTGTCTTTGAA | 3235 |
| Non polyposis colorectal cancer Arg406Term | GATCTTAACCGACTTGCCAAGAAGTTTCAAAGACAAGCAGCA AACTTACAAGATTGTTACCGACTCTATCAGGGTATAAAATCAAC TACCTAATGTTATACAGGCTCTGGAAAAACATGAAG | 3236 |
| CGA-TGA | CTTCATGTTTTTCCAGAGCCTGTATAACATTAGGTAGTTGATTT ATACCCTGATAGAGTCGGTAACAATCTTGTAAGTTTGCTGCTT GTCTTTGAAACTTCTTGGCAAGTCGGTTAAGATC | 3237 |

TABLE 25-continued

MSH2 Mutations and Genome-Connecting Oligos

| Clinical Phenotype & Mutation | Correcting Oligos | SEQ ID NO: |
|---|---|---|
| | ATTGTTACCGACTCTAT | 3238 |
| | ATAGAGTCGGTAACAAT | 3239 |
| Non polyposis colorectal cancer Gln419Term | GCAAACTTACAAGATTGTTACCGACTCTATCAGGGTATAAATC AACTACCTAATGTTATACAGGCTCTGGAAAATTACATGAAGGTAA CAAGTGATTTTGTTTTTTTGTTTTCTTCAACTCA | 3240 |
| CAG-TAG | TGAGTTGAAGGAAAACAAAAAAACAAAATCACTTGTTACCTTC ATGTTTTTCGAGAGCCTGTATAACATTAGGTAGTTGATTTATAC CCTGATAGAGTCGGTAACAATCTTGTAAGTTTGC | 3241 |
| | ATGTTATACAGGCTCTG | 3242 |
| | CAGAGCCTGTATAACAT | 3243 |
| Non polyposis colorectal cancer Gln429Term | TATTCTGTAAAATGAGATCTTTTTATTTGTTGTTTTACTACTTT CTTTTAGGAAAACACCAGAAATTATTGTTGGCAGTTTTTGTGA CTCCTCTTACTGATCTTCGTTCTGACTTCTCCA | 3244 |
| GAG-TAG | TGGAGAAGTCAGAACGAAGATCAGTAAGAGGAGTCACAAAAA CTGCCAACAATAATTTCTGGTGTTTTCCTAAAAGAAAGTAGTA AAACAAACAAATAAAAAGATCTCATTTTACAGAATA | 3245 |
| | GAAAACACCAGAAATTA | 3246 |
| | TAATTTTGGTGTTTTC | 3247 |
| Non polyposis colorectal cancer Leu458Term | CTCCTCTTACTGATCTTCGTTCTGACTTCTCCAAGTTTCAGGA AATGATAGAAACAACTTTAGATATGGATCAGGTATGGAATATA CTTTTTAATTTAAGCAGTAGTTATTTTTAAAAAGC | 3248 |
| TTA-TGA | GCTTTTTAAAAATAACTACTGCTTAAATTTAAAAGTATATTGCA TACCTGATCCATATCTAAAGTTGTTTCTATCATTTCCTGAAACT TGGAGAAGTCAGAACGAAGATCAGTAAGAGGAG | 3249 |
| | AACAACTTTAGATATGG | 3250 |
| | CCATATCTAAAGTTGTT | 3251 |
| Non polyposis colorectal cancer Gln518Term | TTTCTTCTTGATTATCAAGGCTTGGACCCTGGCAAAGAGATTA AACTGGATTCCAGTGCACAGTTTGGATATTACTTCGTGTAAC CTGTAAGGAAGAAAAAGTCCTTCGTAACAATAAAA | 3252 |
| CAG-TAG | TTTTATTGTTACGAAGGACTTTTTCTTCCTTACAGGTTACACGA AGTAATATCCAAACTGTGCACTGGAATCCAGTTTAATCTGTT TGCCAGGGTCCAAGCCTTGATAATCAAGAAGAAA | 3253 |
| | CCAGTGCACAGTTTGGA | 3254 |
| | TCCAAACTGTGCACTGG | 3255 |
| Non polyposis colorectal cancer Arg524Pro | GCTTGGACCCTGGCAAACAGATTAAACTGGATTCCAGTGCAC AGTTTGGATATTACTTTCGTGTAACCTGTAAGGAAGAAAAAGT CCTTCGTAACAATAAAAACTTTAGTACTGTAGATAT | 3256 |
| CGT-CCT | ATATCTACAGTACTTAAAGTTTTTATTGTTACGAAGGACTTTTTC TTCCTTACAGGTTACACGTAAAGTAATATCCAAACTGTGCACTG GAATCCAGTTTAATCTGTTTGCCAGGGTCCAAGC | 3257 |
| | TTACTTTCGTGTAACCT | 3258 |
| | AGGTTACACGAAAGTAA | 3259 |
| Non polyposis colorectal cancer Glu562Tal | TTAATATTTTTAATAAAACTGTTATTTCGATTTGCAGCAAATTGA CTTCTTTAAATGAAGAGTATACCAAAAATAAAACAGAATATGAA GAAGCCCAGGATGCCATTGTTAAAGAAATTGT | 3260 |
| GAG-GTG | ACAATTTCTTTAACAATGGCATCCTGGGCTTCTTCATATTCTGT TTTATTTTGGTATACTCTTCATTTAAAGAAGTCAATTTGCTGC AAATCGAAATAACAGTTTTATTAAAAATATTAA | 3261 |

TABLE 25-continued

MSH2 Mutations and Genome-Connecting Oligos

| Clinical Phenotype & Mutation | Correcting Oligos | SEQ ID NO: |
|---|---|---|
| | AAATGAAGAGTATACCA | 3262 |
| | TGGTATACTCTTCATTT | 3263 |
| Glioma Glu580Term | AATGAAGAGTATACCAAAAATAAAACAGAATATGAAGAAGCCC AGGATGCCATTGTAAAGAAATTGTCAATATTTGTTCAGGTAAA CTTAATAGAACTAATAATGTTCTGAATGTCACCT | 3264 |
| GAA-TAA | AGGTGACATTCAGAACATTATTAGTTCTATTAAGTTTACCTGAA GAAATATTGACAATTTCTTTAAGAATGGCATCCTGGGCTTCTT CATATTCTGTTTTATTTTTGGTATACTCTTCATT | 3265 |
| | TTGTTAAAGAAATTGTC | 3266 |
| | GACAATTTCTTTAACAA | 3267 |
| Non polyposis colorectal cancer Gln601Term | TGTTTTTATTTTTATACAGGGTATGTAGAACCAATGCAGACACT CAATGATGTGTTAGCTCAGCTAGATGCTGTTGTCAGCTTTGCT CACGTGTCAAATGGAGCACCTGTTCCATATGTAC | 3268 |
| CAG-TAG | GTACATATGGAACAGGTGCTCCATTTGACACGTGAGCAAAGC TGACAACAGCATCTAGCTGAGCTAACACATCATTGAGTGTCTG CATTGGTTCTACATAGCCTGTATAAAAATAAAAACA | 3269 |
| | TGTTAGCTCAGCTAGAT | 3270 |
| | ATCTAGCTGAGCTAACA | 3271 |
| Non polyposis colorectal cancer Tyr619Term | AGCTCAGCTAGATGCTGTTGTCAGCTTTGCTCACGTGTCAAAT GGAGCACCTGTTCCATATGTACGACCAGCCATTTTGGAGAAA GGACAAGGAAGAATTATATTAAAAGCATCCAGGCAT | 3272 |
| TAT-TAG | ATGCCTGGATGCTTTTAATATAATTCTTCCTTGTCCTTTCTCCA AAATGGCTGGTCGTACATATGGAACAGGTGCTCCATTTGACA CGTGAGCAAAGCTGACAACAGCATCTAGCTGAGCT | 3273 |
| | GTTCCATATGTACGACC | 3274 |
| | GGTCGTACATATGGAAC | 3275 |
| Non polyposis colorectal cancer Arg621Term | CAGCTAGATGCTGTTGTCAGCTTTGCTCACGTGTCAAATGGA GCACCTGTTCCATATGTACGACCAGCCATTTTGGAGAAAGGA CAAGGAAGAATTATATTAATAGCATCCAGGCATGCTT | 3276 |
| CGA-TGA | AAGCATGCCTGGATGCTTTTAATATAATTCTTCCTTGTCCTTTC TCCAAAATGGCTGGTCGTACATATGGAACAGGTGCTCCATTT GACACGTGAGCAAAGCTGACAACAGCATCTAGCTG | 3277 |
| | CATATGTACGACCAGCC | 3278 |
| | GGCTGGTCGTACATATG | 3279 |
| Non polyposis colorectal cancer Pro622Leu | TAGATGCTGTTGTCAGCTTTGCTCAGGTGTCAAATGGAGCAC CTGTTCCATATGTACGACCAGCCATTTTGGAGAAAGGACAAG GAAGAATTATATTAAAAGCATCCAGGCATGCTTGTGT | 3280 |
| CCA-CTA | ACACAAGCATGCCTGGATGCTTTTAATATAATTCTTCCTTGTC CTTTCTCCAAAATGGCTGGTCGTACATATGGAACAGGTGCTC CATTTGACACGTGAGCAAAGCTGACAACAGCATCTA | 3281 |
| | TGTACGACCAGCCATTT | 3282 |
| | AAATGGCTGGTCGTACA | 3283 |
| Non polyposis colorectal cancer Ala636Pro | CCTGTTCCATATGTACGACCAGCCATTTTGGAGAAAGGACAA GGAAGAATTATATTAAAAGCATCCAGGCATGCTTGTGTTGAAG TTCAAGATGAAATTGCATTTATTCCTAATGACGTAT | 3284 |
| GCA-CCA | ATACGTCATTAGGAATAAATGCAATTTCATCTTGAAGTTCAACA CAAGCATGCCTGGATGCTTTTAATATAATTCTTCCTTGTCCTTT CTCCAAAATGGCTGGTCGTACATATGGAACAGG | 3285 |

TABLE 25-continued

MSH2 Mutations and Genome-Connecting Oligos

| Clinical Phenotype & Mutation | Correcting Oligos | SEQ ID NO: |
|---|---|---|
| | TATTAAAAGCATCCAGG | 3286 |
| | CCTGGATGCTTTTAATA | 3287 |
| Non polyposis colorectal cancer TTis639Arg | ATGTACGACCAGCCATTTTGGAGAAAGGACAAGGAAGAATTA TATTAAAAGCATCCAGGCATGCTTGTGTTGAAGTTCAAGATGA AATTGCATTTATTCCTAATGACGTATACTTTGAAAA | 3288 |
| CAT-CGT | TTTTCAAAGTATACGTCATTAGGAATAAATGCAATTTCATCTTG AACTTCAACACAAGCATGCCTGGATGCTTTTAATATAATTCTTC CTTGTCCTTTCTCCAAAATGGCTGGTCGTACAT | 3289 |
| | ATCCAGGCATGCTTGTG | 3290 |
| | CACAAGCATGCCTGGAT | 3291 |
| Non polyposis colorectal cancer TTis639Tyr | TATGTACGACCAGCCATTTTGGAGAAAGGACAAGGAAGAATT ATATTAAAAGCATCCAGGCATGCTTGTGTTGAAGTTCAAGATG AAATTGCATTTATTCCTAATGACGTATACTTTGAAA | 3292 |
| CAT-TAT | TTTCAAAGTATACGTCATTAGGAATAAATGCAATTTCATCTTGA ACTTCAACACAAGCATGCCTGGATGCTTTTAATATAATTCTTC CTTGTCCTTTCTCCAAAATGGCTGGTCGTACATA | 3293 |
| | CATCCAGGCATGCTTGT | 3294 |
| | ACAAGCATGCCTGGATG | 3295 |
| Non polyposis colorectal cancer Glu647Lys | AAAGGACAAGGAAGAATTATATTAAAAGCATCCAGGCATGGTT GTGTTGAAGTTCAAGATGAAATTGCATTTATTCCTAATGACGT ATACTTTGAAAAAGATAAACAGATGTTCCACATCA | 3296 |
| GAA-AAA | TGATGTGGAACATCTGThTATCTTTTTCAAAGTATACGTCATTA GGAATAAATGCAATTTCATCTTGAACTTCAACACAAGCATGCC TGGATGCTTTTAATATAATTCTTCCTTGTCCTTT | 3297 |
| | TTCAAGATGAAATTGCA | 3298 |
| | TGCAATTTCATCTTGAA | 3299 |
| Non polyposis colorectal cancer Tyr656Term | ATCCAGGCATGCTTGTGTTGAAGTTCAAGATGAAATTGCATTT ATTCCTAATGACGTATACTTTGAAAAAGATAAACAGATGTTCCA CATCATTACTGGTAAAAAACCTGGTTTTTGGGCT | 3300 |
| TAC-TAG | AGCCCAAAAACCAGGTTTTTTACCAGTAATGATGTGGAACATC TGTTTATCTTTTTCAAAGTATACGTCATTAGGAATAAATGCAAT TTCATCTTGAACTTCAACACAAGCATGCCTGGAT | 3301 |
| | GACGTATACTTTGTAAAA | 3302 |
| | TTTTCAAAGTATACGTC | 3303 |
| Non polyposis colorectal cancer Gly674Asp | GAAAGAAGTTTAAAATCTTGCTTTCTGATATAATTTGTTTTGTA GGCCCCAATATGGGAGGTAAATCAACATATATTCGACAAACT GGGGTGATAGTACTCATGGCCCAAATTGGGTGTTT | 3304 |
| GGT-GAT | AAACACCCAATTTGGGCCATGAGTAGTATCACCCCAGTTTGTC GAATATATGTTGATTTACCTCCCATATTGGGGCCTACAAAACA AATTATATCAGAAAGCAAGATTTTAAACTTCTTTTC | 3305 |
| | TATGGGAGGTAAATCAA | 3306 |
| | TTGATTTACCTCCCATA | 3307 |
| Non polyposis colorectal cancer Arg680Term | TTGCTTTCTGATATAATTTGTTTTGTAGGCCCCAATATGGGAG GTAAATCAACATATATTCGACAAACTGGGGTGATAGTACTCAT GGCCCAAATTGGGTGTTTTGTGCCATGTGAGTCAG | 3308 |
| CGA-TGA | CTGACTCACATGGCACAAAACACCCAATTTGGGCCATGAGTA CTATCACCCCAGTTTGTCGAATATATGTTGATTTACCTCCCAT ATTGGGGCCTACAAAACAAATTATATCAGAAAGCAA | 3309 |

TABLE 25-continued

MSH2 Mutations and Genome-Connecting Oligos

| Clinical Phenotype & Mutation | Correcting Oligos | SEQ ID NO: |
|---|---|---|
| | CATATATTCGACAAACT | 3310 |
| | AGTTTGTCGAATATATG | 3311 |
| Non polyposis colorectal cancer Gly692Arg | ATGGGAGGTAAATCAACATATATTCGACAAAACTGGGGTGATAGTACTCATGGCCCAAATTGGGTGTTTTGTGCCATGTGAGTCAGCAGAAGTGTCCATTGTGGACTGCATCTTAGCCCGAG | 3312 |
| GGG-CGG | CTCGGGCTAAGATGCAGTCCACAATGGACACTTCTGCTGACTCACATGGCACAAAACACCCAATTTGGGCCATGAGTACTATCACCCCAGTTTGTCGAATATATGTTGATTTACCTCCCAT | 3313 |
| | CCCAAATTGGGTGTTTT | 3314 |
| | AAAACACCCAATTTGGG | 3315 |
| Non polyposis colorectal cancer Cys697Arg | ACATATATTCGACAAACTGGGGTGATAGTACTCATGGCCCAAATTGGGTGTTTTGTGCCATGTGAGTCAGCAGAAGTGTCCATTGTGGACTGCATCTTAGCCCGAGTAGGGGCTGGTGACA | 3316 |
| TGT-CGT | TGTCACCAGCCCCTACTCGGGCTAAGATGCAGTCCACAATGGACACTTCTGCTGACTCACATGGCACAAAACACCCAATTTGGGCCATGAGTACTATCACCCCAGTTTGTCGAATATATGT | 3317 |
| | TTGTGCCATGTGAGTCA | 3318 |
| | TGACTCACATGGCACAA | 3319 |
| Non polyposis colorectal cancer Cys697Phe | CATATATTCGACAAACTGGGGTGATAGTACTCATGGCCCAAATTGGGTGTTTTGTGCCATGTGAGTCAGCAGAAGTGTCCATTGTGGACTGCATCTTAGCCCGAGTAGGGGCTGGTGACAG | 3320 |
| TGT-TTT | CTGTCACCAGCCCCTACTCGGGCTAAGATGCAGTCCACAATGGACACTTCTGCTGACTCACATGGCACAAAACACCCAATTTGGGCCATGAGTACTATCACCCCAGTTTGTCGAATATATG | 3321 |
| | TGTGCCATGTGAGTCAG | 3322 |
| | CTGACTCACATGGCACA | 3323 |
| Non polyposis colorectal cancer Gln718Term | GAGTCAGCAGAAGTGTCCATTGTGGACTGCATCTTAGCCCGAGTAGGGGCTGGTGACAGTCAATTGAAAGGAGTCTCCACGTTCATGGCTGAAATGTTGGAAACTGCTTCTATCCTCAGGT | 3324 |
| CAA-TAA | ACCTGAGGATAGAAGCAGTTTCCAACATTTCAGCCATGAACGTGGAGACTCCTTTCAATTGACTGTCACCAGCCCCTACTCGGGCTAAGATGCAGTCCACAATGGACACTTCTGCTGACTC | 3325 |
| | GTGACAGTCAATTGAAA | 3326 |
| | TTTCAATTGACTGTCAC | 3327 |
| Non polyposis colorectal cancer Leu811Term | CCAATCAGATACCAACTGTTAATAATCTACATGTCACAGCACTCACCACTGAAGAGACCTTAACTATGCTTTATCAGGTGAAGAAGGTATGTACTATTGGAGTACTCTTAAATTCAGAACT | 3328 |
| TTA-TGA | AGTTCTGAATTTAGAGTACTCCAATAGTACATACCTTTCTTCACCTGATTAAAGCATAGTTAAGGTCTCTTCAGTGGTGAGTGCTGTGACATGTAGATTATTAACAGTTGGTATCTGATTGG | 3329 |
| | AGAGACCTTAACTATGC | 3330 |
| | GCATAGTTAAGGTCTCT | 3331 |
| Non polyposis colorectal cancer Ala834Thr | TTCCCCAAATTTCTTATAGGTGTCTGTGATCAAAGTTTTGGGATTCATGTTGCAGAGCTTGCTAATTTCCCTAAGCATGTAATAGAGTGTGCTAAACAGAAAGCCCTGGAACTTGAGGAGT | 3332 |
| GCT-ACT | ACTCCTCAAGTTCCAGGGCTTTCTGTTTAGCACACTCTATTACATGCTTAGGGAAATTAGCAAGCTCTGCAACATGAATCCCAAAACTTTGATCACAGACACCTATAAGAAATTTGGGGAA | 3333 |

TABLE 25-continued

MSH2 Mutations and Genome-Connecting Oligos

| Clinical Phenotype & Mutation | Correcting Oligos | SEQ ID NO: |
|---|---|---|
| | CAGAGCTTGCTAATTTC | 3334 |
| | GAAATTAGCAAGCTCTG | 3335 |
| Non polyposis colorectal cancer Gln861Term<br><br>CAA-TAA | ATAGAGTGTGCTAAACAGAAAGCCCTGGAACTTGAGGAGTTT CAGTATATTGGAGAATCGCAAGGATATGATATCATGGAACCAG CAGCAAAGAAGTGCTATCTGGAAAGAGAGGTTTGTC | 3336 |
| | GACAAACCTCTCTTTCCAGATAGCACTTCTTTGCTGCTGGTTC CATGATATCATATCCTTGCGATTCTCCAATATACTGAAACTCCT CAAGTTCCAGGGCTTTCTGTTTAGCACACTCTAT | 3337 |
| | GAGAATCGCAAGGATAT | 3338 |
| | ATATCCTTGCGATTCTC | 3339 |
| Non polyposis colorectal cancer Thr905Arg<br><br>ACA-AGA | AGGAGTTCCTGTCCAAGGTGGAACAAATGCCCTTTACTGAAAT GTCAGAAGAAAACATCACAATAAAGTTAAAACAGCTAAAAGCT GAAGTAATAGCAAAGAATAATAGCTTTGTAAATGA | 3340 |
| | TCATTTACAAAGCTATTATTCTTTGCTATTACTTCAGCTTTTAG CTGTTTTAACTTTATTGTGATGTTTTCTTCTGACATTTCAGTAA AGGGCATTTGTTTCACCTTGGACAGGAACTCCT | 3341 |
| | AAACATCACAATAAAGT | 3342 |
| | ACTTTATTGTGATGTTT | 3343 |

EXAMPLE 19

Human Mismatch Repair—MSH6

The human MSH6 gene is homologous to the bacterial mutS gene, which is involved in mismatch repair. Mutations in the MSH6 gene have been identified in a variety of cancers, including particularly hereditary nonpolyposis colorectal cancer. The attached table discloses the correcting oligonucleotide base sequences for the MSH6 oligonucleotides of the invention.

TABLE 26

MSH6 Mutations and Genome-Correcting Oligos

| Clinical Phenotype & Mutation | Correcting Oligos | SEQ ID NO: |
|---|---|---|
| Non-polyposis colorectal cancer Ser144Ile AGC-ATC | GGAAATCAGTCCGTGTTCATGTACAGTTTTTTGATGACAGCCC AACAAGGGGCTGGGTTAGCAAAAGGCTTTTAAAGCCATATAC AGGTAAGAGTCACTACTGCCATGTGTGTGTTTGT | 3344 |
| | ACAAACACACACACATGGCAGTAGTGACTCTTACCTGTATATG GCTTTAAAAGCCTTTTGCTAACCCAGCCCCTTGTTGGGCTGT CATCAAAAAACTGTACATGAACACGGACTGATTTCC | 3345 |
| | CTGGGTTAGCAAAAGGC | 3346 |
| | GCCTTTTGCTAACCCAG | 3347 |
| Endometrial cancer Ser156Term TCA-TGA | CGTGAGCCTCTGCACCCGGCCCTTATTGTTTATAAATACATTT CTTTCTAGGTTCAAAATCAAAGGAAGCCCAGAAGGGAGGTCA TTTTTACAGTGCAAAGCCTGAAATACTGAGAGCAAT | 3348 |
| | ATTGCTCTCAGTATTTCAGGCTTTGCACTGTAAAAATGACCTC CCTTCTGGGCTTCCTTTGATTTTGAACCTAGAAAGAAATGTAT TTATAAACAATAAGGGCCGGGTGCAGAGGCTCACG | 3349 |

TABLE 26-continued

MSH6 Mutations and Genome-Correcting Oligos

| Clinical Phenotype & Mutation | Correcting Oligos | SEQ ID NO: |
|---|---|---|
| | TTCAAAATCAAAGGAAG | 3350 |
| | CTTCCTTTGATTTTGAA | 3351 |
| Early onset colorectal cancer Tyr214Term TAC-TAG | TTCCAAATTTTGATTTGTTTTTAAATACTCTTTCCTTGCCTGGC AGGTAGGCACAACTTACGTAACAGATAAGAGTGAAGAAGATA ATGAAATTGAGAGTGAAGAGGAAGTACAGCCTAAG | 3352 |
| | CTTAGGCTGTACTTCCTCTTCACTCTCAATTTCATTATCTTCTT CACTCTTATCTGTTACGTAAGTTGTGCCTACCTGCCAGGCAA GGAAAGAGTATTTAAAAACAAATCAAAATTTGGAA | 3353 |
| | ACAACTTACGTAACAGA | 3354 |
| | TCTGTTACGTAAGTTGT | 3355 |
| Endometrial cancer Arg248Term CGA-TGA | GAAGAGGAAGTACAGCCTAAGACACAAGGATCTAGGCGAAGT AGCCGCCAAATAAAAAAACGAAGGGTCATATCAGATTCTGAG AGTGACATTGGTGGCTCTGATGTGGAATTTAAGCCAG | 3356 |
| | CTGGCTTAAATTCCACATCAGAGCCACCAATGTCACTCTCAGA ATCTGATATGACCCTTCGTTTTTTTATTTGGCGGCTACTTCGC CTAGATCCTTGTGTCTTAGGCTGTACTTCCTCTTC | 3357 |
| | TAAAAAAACGAAGGGTC | 3358 |
| | GACCCTTCGTTTTTTTA | 3359 |
| Colorectal cancer Ser285Ile AGT-ATT | TTAAGCCAGACACTAAGGAGGAAGGAAGCAGTGATGAAATAA GCAGTGGAGTGGGGGATAGTGAGAGTGAAGGCCTGAACAGC CCTGTCAAAGTTGCTCGAAAGCGGAAGAGAATGGTGAC | 3360 |
| | GTCACCATTCTCTTCCGCTTTCGAGCAACTTTGACAGGGCTG TTCAGGCCTTCACTCTCACTATCCCCCACTCCACTGCTTATTT CATCACTGCTTCCTTCCTCCTTAGTGTCTGGCTTAA | 3361 |
| | GGGGGATAGTGAGAGTG | 3362 |
| | CACTCTCACTATCCCCC | 3363 |
| Colorectal cancer Gly566Arg GGA-AGA | GAGGAAGATTCTTCTGGCCATACTCGTGCATATGGTGTGTGC TTTGTTGATACTTCACTGGGAAAGTTTTTCATAGGTCAGTTTTC AGATGATCGCCATTGTTCGAGATTTAGGACTCTAG | 3364 |
| | CTAGAGTCCTAAATCTCGAACJAATGGCGATCATCTGAAAACTG ACCTATGAAAAACTTTCCCAGTGAAGTATCAACAAAGCACACA CCATATGCACGAGTATGGCCAGAAGAATCTTCCTC | 3365 |
| | CTTCACTGGGAAAGTTT | 3366 |
| | AAACTTTCCCAGTGAAG | 3367 |
| Non-polyposis colorectal cancer Gln698Glu CAG-GAG | GAATTGGCCCTCTCTGCTCTAGGTGGTTGTGTCTTCTACCTC AAAAAATGCCTTATTGATCAGGAGCTTTTATCAATGGCTAATTT TGAAGAATATATTCCCTTGGATTCTGACACAGTCA | 3368 |
| | TGACTGTGTCAGAATCCAAGGGAATATATTCTTCAAAATTAGC CATTGATAAAAGCTCCTGATCAATAAGGCATTTTTTGAGGTAG AAGACACAACCACCTAGAGCAGAGAGGGCCAATTC | 3369 |
| | TTATTGATCAGGAGCTT | 3370 |
| | AAGCTCCTGATCAATAA | 3371 |
| Endometrial cancer Gln731Term CAA-TAA | CCCTTGGATTCTGACACAGTCAGCACTACAAGATCTGGTGCT ATCTTCACCAAAGCCTATCAACGAATGGTGCTAGATGCAGTG ACATTAAACAACTTGGAGATTTTTCTGAATGGAACAA | 3372 |
| | TTGTTCCATTCAGAAAAATCTCCAAGTTGTTTAATGTCACTGCA TCTAGCACCATTCGTTGATAGGCTTTGGTGAAGATAGCACCA GATCTTGTAGTGCTGACTGTGTCAGAATCCAAGGG | 3373 |
| | AAGCCTATCAACGAATG | 3374 |
| | CATTCGTTGATAGGCTT | 3375 |

TABLE 26-continued

MSH6 Mutations and Genome-Correcting Oligos

| Clinical Phenotype & Mutation | Correcting Oligos | SEQ ID NO: |
|---|---|---|
| Colorectal cancer Val800Leu GTT-CTT | GCCCCACTCTGTAACCATTATGCTATTAATGATCGTCTAGATG CCATAGAAGACCTCATGGTTGTGCCTGACAAAATCTCCGAAG TTGTAGAGCTTCTAAAGAAGCTTCCAGATCTTGAGA | 3376 |
| | TCTCAAGATCTGGAAGCTTCTTTAGAAGCTCTACAACTTCGGA GATTTTGTCAGGCACAACCATGAGGTCTTCTATGGCATCTAGA CGATCATTAATAGCATAATGGTTACAGAGTGGGGC | 3377 |
| | ACCTCATGGTTGTGCCT | 3378 |
| | AGGCACAACCATGAGGT | 3379 |
| Colorectal cancer Asp803Gly GAC-GGC | GTAACCATTATGCTATTAATGATCGTCTAGATGGCATAGAAGA CCTCATGGTTGTGCCTGACAAAATCTCCGAAGTTGTAGAGCT TCTAAAGAAGCTTCCAGATCTTGAGAGGCTACTCAG | 3380 |
| | CTGAGTAGCCTCTCAAGATCTGGAAGCTTCTTTAGAAGCTA CAACTTCGGAGATTTTGTCAGGCACAACCATGAGGTCTTCTAT GGCATCTAGACGATCATTAATAGCATAATGGTTAC | 3381 |
| | TGTGCGTGACAAAATCT | 3382 |
| | AGATTTTGTCAGGCACA | 3383 |
| Non-polyposis colorectal cancer Tyr850Cys TAC-TGC | CTCCCCTGAAGAGTCAGAACCACCCAGACAGCAGGGCTATAA TGTATGAAGAAACTACATACAGCAAGAAGAAGATTATTGATTT TCTTTCTGCTCTGGAAGGATTCAAAGTAATGTGTAA | 3384 |
| | TTACACATTACTTTGAATCCTTCCAGAGCAGAAAGAAATCAA TAATCTTCTTCTTGCTGTATGTAGTTTCTTCATACATTATAGCC CTGCTGTCTGGGTGGTTCTGACTCTTCAGGGGAG | 3385 |
| | AACTACATACAGCAAGA | 3386 |
| | TCTTGCTGTATGTAGTT | 3387 |
| Colorectal cancer Pro1087Thr CCC-ACC | TATAGTCGAGGGGTGATGGTCCTATGTGTCGCCCAGTAATT CTGTTGCCGGAAGATACCCCCCCCTTCTTAGAGCTTAAAGGA TCACGCCATCCTTGCATTACGAAGACTTTTTTTGGAG | 3388 |
| | CTCCAAAAAAAGTCTTCGTAATGCAAGGATGGCGTGATCCTTT AAGCTCTAAGAAGGGGGGGGTATCTTCCGGCAACAGAATTAC TGGGCGACACATAGGACCATCACCCCCTCGACTATA | 3389 |
| | AAGATACCCCCCCCTTC | 3390 |
| | GAAGGGGGGGGTATCTT | 3391 |
| Non-polyposis colorectal cancer Gln1258Term CAA-TAA | ACTATAAAATGTCGTACATTATTTFCAACTCACTACCATTCATT AGTAGAAGATTATTCTCAAAATGTTGCTGTGCGCCTAGGACAT ATGGTATGTGCAAATTGTTTTFTTCCACAAATTC | 3392 |
| | GAATTTGTGGAAAAAAACAATTTGCACATACCATATGTCCTAG GCGCACAGCAACATTTTGAGAATAATCTTCTACTAATGAATGG TAGTGAGTTGAAAATAATGTACGACATTTTATAGT | 3393 |
| | ATTATTCTCAAAATGTT | 3394 |
| | AACATTTTGAGAATAAT | 3395 |

EXAMPLE 20

Hyperlipidemia—APOE

Hyperlipidemia is the abnormal elevation of plasma cholesterol and/or triglyceride levels and it is one of the most common diseases. The human apolipoprotein E protein is involved in the transport of endogenous lipids and appears to be crucial for both the direct removal of cholesterol-rich LDL from plasma and conversion of IDL particles to LDL particles. Individuals who either lack apolipoprotein E or who are homozygous for particular alleles of apoE may have have a condition known as dysbetalipoproteinemia, which is characterized by elevated plasma cholesterol and triglyceride levels and an increased risk for atherosclerosis.

In a comprehensive review of apoE variants, de Knijff et al., Hum. Mutat. 4:178-194 (1994) found that 30 variants had been characterized, including the most common variant, apoE3. To that time, 14 apoE variants had been found to be associated with familial dysbetalipoproteinemia. The attached table discloses the correcting oligonucleotide base sequences for the APOE oligonucleotides of the invention.

TABLE 27

APOE Mutations and Genome-Correcting Oligos

| Clinical Phenotype & Mutation | Correcting Oligos | SEQ ID NO: |
|---|---|---|
| Apolipoprotein Glu13Lys cGAG-AAG | TTGTTCCACACAGGATGCCAGGCCAAGGTGGAGCAAGCGGT GGAGACAGAGCCGGAGCCCGAGCTGCGCCAGCAGACCGAG TGGCAGAGCGGCCAGCGCTGGGAACTGGCACTGGGTCGCT | 3396 |
| | AGCGACCCAGTGCCAGTTCCCAGCGCTGGCCGCTCTGCCAC TCGGTCTGCTGGCGCAGCTCGGGCTCCGGCTCTGTCTCCAC CGCTTGCTCCACCHGGCCTGGCATCCTGTGTGGAACAA | 3397 |
| | CGGAGCCCGAGCTGCGC | 3398 |
| | GCGCAGCTCGGGCTCCG | 3399 |
| Apolipoprotein E Trp20Term TGGc-TGA | CAAGGTGGAGCAAGCGGTGGAGACAGAGCCGGAGCCCGAG CTGCGCCAGCAGACCGAGTGGCAGAGCGGCCAGCGCTGGG AACTGGCACTGGGTCGCTTFTGGGATTACCTGCGCTGGGTG | 3400 |
| | CACCCAGCGCAGGTAATCCCAAAAGCGACCCAGTGCCAGTT CCCAGCGCTGGCCGCTCTGCCACTCGGTCTGCTGGCGCAGC TCGGGCTCCGGCTCTGTCTCCACCGCTTGCTGCACCTTG | 3401 |
| | ACCGAGTGGCAGAGCGG | 3402 |
| | CCGCTCTGCCACTCGGT | 3403 |
| Apolipoprotein E Leu28Pro CTG-CCG | CAGAGCCGGAGCCCGAGCTGCGCCAGCAGACCGAGTGGCA GAGCGGCCAGCGCTGGGAACTGGCACTGGGTCGCTTTTGGG ATTACCTGCGCTGGGTGCAGACACTGTCTGAGCAGGTGCA | 3404 |
| | TGCACCTGCTCAGACAGTGTCTGCACCCAGCGCAGGTAATCC CAAAAGCGACCCAGTGCCAGTTCCCAGCGCTGGCCGCTCTG CCACTCGGTGTGCTGGCGCAGCTCGGGCTCCGGCTCTG | 3405 |
| | CTGGGAACTGGCACTGG | 3406 |
| | CCAGTGCCAGTTCCCAG | 3407 |
| Apolipoprotein E Cys112Arg gTGC-CGC | CGGCTGTCCAAGGAGCTGCAGGCGGCGCAGGCCCGGCTGG GCGCGGACATGGAGGACGTGTGCGGCCGCCTGGTGCAGTA CCGCGGCGAGGTGCAGGCCATGCTCGGCCAGAGCACCGAGG | 3408 |
| | CCTCGGTGCTCTGGCCGAGCATGGCCTGCACCTCGCCGCGG TACTGCACCAGGCGGCCGCACACGTCCTCCATGTCCGCGCC CAGCCGGGCCTGCGCCGCCTGCAGCTCCTTGGACAGCCG | 3409 |
| | AGGACGTGTGCGGCCGC | 3410 |
| | GCGGCCGCACACGTCCT | 3411 |
| Apolipoprotein E Gly127Asp GGC-GAC | ACATGGAGGACGTGTGCGGCCGCCTGGTGCAGTACCGCGG CGAGGTGCAGGCCATGCTCGGCCAGAGCACCGAGGAGCTGT CGGGTGCGCCTCGCCTCCCACCTGCGCAAGCTGCGTAAGCG | 3412 |
| | CGCTTACGCAGCTTGCGCAGGTGGGAGGCGAGGCGCACCC GCAGCTCCTCGGTGCTCTGGCCGAGCATGGCCTGCACCTCG CCGCGGTACTGCACCAGGCGGCCGCACACGTCCTCCATGT | 3413 |
| | CATGCTCGGCCAGAGCA | 3414 |
| | TGCTCTGGCCGAGCATG | 3415 |
| Apolipoprotein E Arg136Cys gCGC-TGC | GTGCAGTACCGCGGCGAGGTGCAGGCCATGCTCGGCCAGA GCACCGAGGAGCTGCGGGTGCGCCTCGCCTCCCACCTGCG CAAGCTGCGTAAGCGGCTCCTCCGCGATGCCGATGACCTGC | 3416 |
| | GCAGGTCATGGGCATCGCGGAGGAGCCGCTTACGCAGCTTG CGCAGGTGGGAGGCGAGGCGCACCCGCAGCTCCTCGGTGC TCTGGCCGAGCATGGCCTGCACCTCGCCGCGGTACTGCAC | 3417 |

TABLE 27-continued

APOE Mutations and Genome-Correcting Oligos

| Clinical Phenotype & Mutation | Correcting Oligos | SEQ ID NO: |
|---|---|---|
| | TGCGGGTGCGCCTCGCC | 3418 |
| | GGCGAGGCGCACCCGCA | 3419 |
| Apolipoprotein E Arg136His CGC-CAC | TGCAGTACCGCGGCGAGGTGCAGGCCATGCTCGGCCAGAG CACCGAGGAGCTGCGGGTGCGCCTCGCCTCCCACCTGCGC AAGCTGCGTAAGCGGCTCCTCCGCGATGCCGATGACCTGCA | 3420 |
| | TGCAGGTCATCGGCATCGCGGAGGAGCCGCTTACGCAGCTT GCGCAGGTGGGAGGCGAGGCGCACCCGCAGCTCCTCGGTG CTCTGGCCGAGCATGGCCTGCACCTCGCCGCGGTACTGCA | 3421 |
| | GCGGGTGCGCCTCGCCT | 3422 |
| | AGGCGAGGCGCACCCGC | 3423 |
| Apolipoprotein E Arg136Ser gCGC-AGC | GTGCAGTACCGCGGCGAGGTGCAGGCCATGCTCGGCCAGA GCACCGAGGAGCTGCGGGTGCGCCTCGCCTCGCACCTGCG CAAGCTGCGTAAGCGGCTCCTCCGCGATGCCGATGACCTGC | 3424 |
| | GCAGGTCATCGGCATCGCGGAGGAGCCGCTTACGCAGTTG CGCAGGTGGGAGGCGAGGCGCACCCGCAGCTCCTCGGTGC TCTGGCCGAGCATGGCCTGCACCTCGCCGCGGTACTGCAC | 3425 |
| | TGCGGGTGCGCCTCGCC | 3426 |
| | GGCGAGGCGCACCCGCA | 3427 |
| Apolipoprotein E Arg142Cys gCGC-TGC | GTGCAGGCCATGCTCGGCCAGAGCACCGAGGAGCTGCGGG TGCGCCTCGCCTCCCACCTGCGCAAGCTGCGTAAGCGGCTC CTCCGCGATGCCGATGACCTGCAGAAGCGCCTGGCAGTGT | 3428 |
| | ACACTGCCAGGCGCTTCTGCAGGTCATCGGCATCGCGGAGG AGCCGCTTACGCAGCTTGCGCAGGTGGGAGGCGAGGCGCA CCCGCAGCTCCTCGGTGCTCTGGCCGAGCATGGCCTGCAC | 3429 |
| | CCCACCTGCGCAAGCTG | 3430 |
| | CAGCTTGCGCAGGTGGG | 3431 |
| Apolipoprotein E Arg142Leu CGC-CTC | TGCAGGCCATGCTCGGCCAGAGCACCGAGGAGCTGCGGGT GCGCCTCGCCTCCCACCTGCGCAAGCTGCGTAAGCGGCTCC TCCGCGATGCCGATGACCTGCAGAAGCGCCTGGCAGTGTA | 3432 |
| | TACACTGCCAGGCGCTTCTGCAGGTCATCGGCATCGCGGAG GAGCCGCTTACGCAGCTTGCGCAGGTGGGAGGCGAGGCGC ACCCGCAGCTCCTCGGTGCTCTGGCCGAGCATGGCCTGCA | 3433 |
| | CCACCTGCGCAAGCTGC | 3434 |
| | GCAGCTTGCGCAGGTGG | 3435 |
| Apolipoprotein E Arg145Cys gCGT-TGT | ATGCTCGGCCAGAGCACCGAGGAGCTGCGGGTGCGCCTCG CCTCCCACCTGCGCAAGCTGCGTAAGCGGCTCCTCCGCGAT GCCGATGACCTGCAGAAGCGCCTGGCAGTGTACCAGGCCG | 3436 |
| | CGGCCTGGTACACTGCCAGGCGCTTCTGCAGGTCATCGGCA TCGCGGAGGAGCCGCTTACGCAGCTTGCGCAGGTGGGAGG CGAGGCGCACCCGCAGGTCCTCGGTGCTCTGGCCGAGCAT | 3437 |
| | GCAAGCTGCGTAAGCGG | 3438 |
| | CCGCTTACGCAGCTTGC | 3439 |
| Apolipoprotein E Arg145Pro CGT-CCT | TGCTCGGCCAGAGCACCGAGGAGCTGCGGGTGCGCCTCGC CTCCCACCTGCGCAAGCTGCGTAAGCGGCTCCTCCGCGATG CCGATGACCTGCAGAAGCGCCTGGCAGTGTACCAGGCCGG | 3440 |
| | CCGGCCTGGTACACTGCCAGGCGCTTCTGCAGGTCATCGGC ATCGCGGAGGAGCCGCTTACGCAGCTTGCGCAGGTGGGAG GCGAGGCGCACCCGCAGCTCCTCGGTGCTCTGGCCGAGCA | 3441 |
| | CAAGCTGCGTAAGCGGC | 3442 |
| | GCCGCTTACGCAGCTTG | 3443 |

TABLE 27-continued

APOE Mutations and Genome-Correcting Oligos

| Clinical Phenotype & Mutation | Correcting Oligos | SEQ ID NO: |
|---|---|---|
| Apolipoprotein E Lys146Gln tAAG-CAG | CTCGGCCAGAGCACCGAGGAGCTGCGGGTGCGCCTCGCCT CCCACCTGCGCAAGCTGCGTAAGCGGCTCCTCCGCGATGCC GATGACCTGCAGAAGCGCCTGGCAGTGTACCAGGCCGGGG | 3444 |
| | CCCCGGCCTGGTACACTGCCAGGCGCTTCTGCAGGTCATCG GCATCGCGGAGGAGCCGCTTACGCAGCTTGCGCAGGTGGGA GGCGAGGCGCACCCGCAGCTCCTCGGTGCTGTGGCCGAG | 3445 |
| | AGCTGCGTAAGCGGCTC | 3446 |
| | GAGCCGCTTACGCAGCT | 3447 |
| Apolipoprotein E Lys146Glu tAAG-GAG | CTCGGCCAGAGCACCGAGGAGCTGCGGGTGCGCCTCGCCT CCCACCTGCGCAAGCTGCGTAAGCGGCTCCTCCGCGATGCC GATGACCTGCAGAAGCGCCTGGCAGTGTACCAGGCCGGGG | 3448 |
| | CCCCGGCCTGGTACACTGCCAGGCGCTTCTGCAGGTCATCG GCATCGCGGAGGAGCCGCTTACGCAGCTTGCGCAGGTGGGA GGCGAGGCGCACCCGCAGCTCCTCGGTGCTCTGGCCGAG | 3449 |
| | AGCTGCGTAAGCGGCTC | 3450 |
| | GAGCCGCTTACGCAGCT | 3451 |
| Apolipoprotein E Arg158Cys gCGC-TGC | GCCTCCCACCTGCGCAAGCTGCGTAAGCGGCTCCTCCGCGA TGCCGATGACCTGCAGAAGCGCCTGGCAGTGTACCAGGCCG GGGCCCGCGAGGGCGCCGAGCGCGGCCTCAGCGCCATCC | 3452 |
| | GGATGGCGCTGAGGCCGCGCTCGGCGCCCTCGCGGGCCCC GGCCTGGTACACTGCCAGGCGCTTCTGCAGGTCATCGGCAT CGCGGAGGAGCCGCTTACGCAGCTTGCGCAGGTGGGAGGC | 3453 |
| | TGCAGAAGCGCCTGGCA | 3454 |
| | TGCCAGGCGCTTCTGCA | 3455 |
| Apolipoprotein E Gln187Glu aCAG-GAG | CGCGAGGGCGCCGAGCGCGGCCTCAGCGCCATCCGCGAGC GCCTGGGGCCCCTGGTGGAACAGGGCCGCGTGCGGGCCGC CACTGTGGGCTCCCTGGCCGGCCAGCCGCTACAGGAGCGGG | 3456 |
| | CCCGCTCCTGTAGCGGCTGGCCGGCCAGGGAGCCCACAGT GGCGGCCCGCACGCGGCCCTGTTCCACCAGGGGCCCCAGG CGCTCGCGGATGGCGCTGAGGCCGCGCTCGGCGCCCTCGCG | 3457 |
| | TGGTGGAACAGGGCCGC | 3458 |
| | GCGGCCCTGTTCCACCA | 3459 |
| Apolipoprotein E Trp210Term TGG-TAG | TGCGGGCCGCCACTGTGGGCTCCCTGGCCGGCCAGCCGCT ACAGGAGCGGGCCCAGGCCTGGGGCGAGCGGCTGCGCGC GCGGATGGAGGAGATGGGCAGCCGGACCCGCGACCGCCTGGA | 3460 |
| | TCCAGGCGGTCGCGGGTCCGGCTGCCCATCTCCTCCATCCG CGCGCGCAGCCGCTCGCCCCAGGCCTGGGCCCGCTCCTGT AGCGGCTGGCCGGCCAGGGAGCCCACAGTGGCGGCCCGCA | 3461 |
| | CCAGGCCTGGGGCGAGC | 3462 |
| | GCTCGCCCCAGGCCTGG | 3463 |
| Apolipoprotein E Arg228Cys cCGC-TGC | CAGGCCTGGGGCGAGCGGCTGCGCGCGCGGATGGAGGAGA TGGGCAGCCGGACCCGCGACCGCCTGGACGAGGTGAAGGA GCAGGTGGCGGAGGTGCGCGCCAAGCTGGAGGAGCAGGCCC | 3464 |
| | GGGCCTGCTCCTCCAGCTTGGCGCGCACCTCCGCCACCTGC TCCTTCACCTCGTCCAGGCGGTCGCGGGTCCGGCTGCCCAT CTCCTCCATCCGCGCGCGCAGCCGCTCGCCCCAGGCCTG | 3465 |
| | CCCGCGACCGCCTGGAC | 3466 |
| | GTCCAGGCGGTCGCGGG | 3467 |
| Apolipoprotein E Glu244Lys | CGGACCCGCGACCGCCTGGACGAGGTGAAGGAGCAGGTGG CGGAGGTGCGCGCCAAGCTGGAGGAGCAGGCCCAGCAGAT | 3468 |

TABLE 27-continued

APOE Mutations and Genome-Correcting Oligos

| Clinical Phenotype & Mutation | Correcting Oligos | SEQ ID NO: |
|---|---|---|
| gGAG-AAG | ACGCCTGCAGGCCGAGGCCTTCCAGGCCCGCCTCAAGAGCT | |
| | AGCTCTTGAGGCGGGCCTGGAAGGCCTCGGCCTGGAGGCGT ATCTGCTGGGCCTGCTCCTCCAGCTTGGCGCGCACCTCCGC CACCTGCTCCTTCACCTCGTCCAGGCGGTCGCGGGTCCG | 3469 |
| | CCAAGCTGGAGGAGCAG | 3470 |
| | CTGCTCCTCCAGCTTGG | 3471 |

EXAMPLE 21

Familial Hypercholesterolemia—LDLR

Familial hypercholesterolemia is characterized by elevation of serum cholesterol bound to low density lipoprotein (LDL) and is, hence, one of the conditions producing a hyperlipoproteinemia phenotype. Familial hypercholesterolemia is an autosomal dominant disorder characterized by elevation of serum cholesterol bound to low density lipoprotein (LDL). Mutations in the LDL receptor (LDLR) gene cause this disorder. The attached table discloses the correcting oligonucleotide base sequences for the LDLR oligonucleotides of the invention.

TABLE 28

LDLR Mutations and Genome-Correcting Oligos

| Cilnical Phenotype & Mutation | Correcting Oligos | SEQ ID NO: |
|---|---|---|
| Hypercholesterolaemia Glu10Term cGAG-TAG | GCGTTGAGAGACCCTTTCTCCTTTTCCTCTCTCTCAGTGGGC GACAGATGCGAAAGAAACGAGTTCCAGTGCCAAGACGGGAA ATGCATCTCCTACAAGTGGGTCTGCGATGGCAGCGCTG | 3472 |
| | CAGCGCTGCCATCGCAGACCCACTTGTAGGAGATGCATTTCC CGTCTTGGCACTGGAACTCGTTTCTTTCGCATCTGTCGCCCA CTGAGAGAGAGGAAAAGGAGAAAGGGTCTCTCAACGC | 3473 |
| | AAAGAAACGAGTTCCAG | 3474 |
| | CTGGAACTCGTTTCTTT | 3475 |
| Hypercholesterolaemia Gln12Term cCAG-TAG | AGAGACCCTTTCTCCTTTTCCTCTCTCTCAGTGGGCGACAGA TGCGAAAGAAACGAGTTCCAGTGCCAAGACGGGAAATGCATC TCCTACAAGTGGGTCTGCGATGGCAGCGCTGAGTGCC | 3476 |
| | GGCACTCAGCGCTGCCATCGCAGACCCACTTGTAGGAGATG CATTTCCCGTCTTGGCACTGGAAGTCGTTTCTTTCGCATCTGT CGCCCACTGAGAGAGAGGAAAAGGAGAAAGGGTCTCT | 3477 |
| | ACGAGTTCCAGTGCCAA | 3478 |
| | TTGGCACTGGAACTCGT | 3479 |
| Hyperchoiesterolaemia Gln14Term cCAA-TAA | CCTTTCTCCTTTTCCTCTCTCTCAGTGGGCGACAGATGCGAA AGAAACGAGTTCCAGTGCCAAGACGGGAAATGCATCTCCTAC AAGTGGGTCTGCGATGGCAGCGCTGAGTGCCAGGATG | 3480 |
| | CATCCTGGCACTCAGCGCTGCCATCGCAGACCCACTTGTAG GAGATGCATTTCCCGTCTTGGCACTGGAACT CATCTGTCGCCCACTGAGAGAGAGGAAAAGGAGAAAGG | 3481 |
| | TCCAGTGCCAAGACGGG | 3482 |
| | CCCGTCTTGGCACTGGA | 3483 |
| Hypercholesterolaemia Trp23Term TGG-TAG | GCGACAGATGCGAAAGAAACGAGTTCCAGTGCCAAGACGGG AAATGCATCTCCTACAAGTGGGTCTGCGATGGCAGCGCTGAG TGCCAGGATGGCTCTGATGAGTCCCAGGAGACGTGCTG | 3484 |
| | CAGCACGTCTCCTGGGACTCATCAGAGCCATCCTGGCACTCA GCGCTGCCATCGCAGACCCACTTGTAGGAGATGCATTTCCCG TCTTGGCACTGGAACTCGTTTCTTTCGCATCTGTCGC | 3485 |

TABLE 28-continued

LDLR Mutations and Genome-Correcting Oligos

| Clinical Phenotype & Mutation | Correcting Oligos | SEQ ID NO: |
|---|---|---|
| | CTACAAGTGGGTCTGCG | 3486 |
| | CGCAGACCCACTTGTAG | 3487 |
| Hypercholesterolaemia Ala29Ser cGCT-TCT | AACGAGTTCCAGTGCCAAGACGGGAAATGCATCTCCTACAAG TGGGTCTGCGATGGCAGCGCTGAGTGCCAGGATGGCTCTGA TGAGTCCCAGGAGACGTGCTGTGAGTCCCCTTTGGGCA | 3488 |
| | TGCCCAAAGGGGACTCACAGCACGTCTCCTGGGACTCATCA GAGCCATCCTGGCACTCAGCGCTGCCATCGCAGACCCACTT GTAGGAGATGCATTTCCCGTCTTGGCACTGGAACTCGTT | 3489 |
| | ATGGCAGCGCTGAGTGC | 3490 |
| | GCACTCAGCGCTGCCAT | 3491 |
| Hypercholesterolaemia Cys31Tyr TGC-TAC | TCCAGTGCCAAGACGGGAAATGCATCTCCTACAAGTGGGTCT GCGATGGCAGCGCTGAGTGCCAGGATGGCTCTGATGAGTCC CAGGAGACGTGCTGTGAGTCCCCTTTGGGCATGATATG | 3492 |
| | CATATCATGCCCAAAGGGGACTCACAGCACGTCTCCTGGGAC TCATCAGAGCCATCCTGGCACTCAGCGCTGCCATCGCAGAC CCACTTGTAGGAGATGCATTTCCCGTCTTGGCACTGGA | 3493 |
| | CGCTGAGTGCCAGGATG | 3494 |
| | CATCCTGGCACTCAGCG | 3495 |
| Hypercholesterolaemia Arg57Cys cCGT-TGT | AATCCTGTCTCTTCTGTAGTGTCTGTCACCTGCAAATCCGGG GACTTCAGCTGTGGGGCCGTGTCAACCGCTGCATTCCTCA GTTCTGGAGGTGCGATGGCCAAGTGGACTGCGACAACG | 3496 |
| | CGTTGTCGCAGTCCACTTGGCCATCGCACCTCCAGAACTGAG GAATGCAGCGGTTGACACGGCCCCCACAGCTGAAGTCCCCG GATTTGCAGGTGACAGACACTACAGAAGAGACAGGATT | 3497 |
| | GTGGGGCCGTGTCAAC | 3498 |
| | GTTGACACGGCCCCCAC | 3499 |
| Hypercholesterolaemia Gln64Term tCAG-TAG | TCTGTCACCTGCAAATCCGGGGACTTCAGCTGTGGGGCCG TGTCAACCGCTGCATTCCTCAGTTCTGGAGGTGCGATGGCCA AGTGGACTGCGACAACGGCTCAGACGAGCAAGGCTGTC | 3500 |
| | GACAGCCTTGCTCGTCTGAGCCGTTGTCGCAGTCCACTTGGC CATCGCACCTCCAGAACTGAGGAATGCAGCGGTTGACACGG CCCCCACAGCTGAAGTCCCCGGATTTGCAGGTGACAGA | 3501 |
| | GCATTCCTCAGTTCTGG | 3502 |
| | CCAGAACTGAGGAATGC | 3503 |
| Hypercholesterolaemia Trp66Gly cTGG-GGG | ACCTGCAAATCCGGGGACTTCAGCTGTGGGGCCGTGTCAA CCGCTGCATTCCTCAGTTCTGGAGGTGCGATGGCCAAGTGG ACTGCGACAACGGCTCAGACGAGCAAGGCTGTCGTAAGT | 3504 |
| | ACTTACGACAGCCTTGCTCGTCTGAGCCGTTGTCGCAGTCCA CTTGGCCATCGCACCTCCAGAACTGAGGAATGCAGCGGTTG ACACGGCCCCCACAGCTGAAGTCCCCGGATTTGCAGGT | 3505 |
| | CTCAGTTCTGGAGGTGC | 3506 |
| | GCACCTCCAGAACTGAG | 3507 |
| Hypercholesterolaemia Trp66Term TGG-TAG | CCTGCAAATCCGGGGACTTCAGCTGTGGGGCCGTGTCAAC CGCTGCATTCCTCAGTTCTGGAGGTGCGATGGCCAAGTGGA CTGCGACAACGGCTCAGACGAGCAAGGCTGTCGTAAGTG | 3508 |
| | CACTTACGACAGCCTTGCTCGTCTGAGCCGTTGTCGCAGTCC ACTTGGCCATCGCACCTCCAGAACTGAGGAATGCAGCGGTG ACACGGCCCCCACAGCTGAAGTCCCCGGATTTGCAGG | 3509 |
| | TCAGTTCTGGAGGTGCG | 3510 |
| | CGCACCTCCAGAACTGA | 3511 |

TABLE 28-continued

LDLR Mutations and Genome-Correcting Oligos

| Cilnical Phenotype & Mutation | Correcting Oligos | SEQ ID NO: |
|---|---|---|
| Hypercholesterolaemia Cys68Arg gTGC-CGC | AAATCCGGGGACTTCAGCTGTGGGGCCGTGTCAACCGCTG CATTCCTCAGTTCTGGAGGTGCGATGGCCAAGTGGACTGCGA CAACGGCTCAGACGAGCAAGGCTGTCGTAAGTGTGGCC | 3512 |
| | GGCCACACTTACGACAGCCTTGCTCGTCTGAGCCGTTGTCGC AGTCCACTTGGCCATCGCACCTCCAGAACTGAGGAATGCAG CGGTTGACACGGCCCCCACAGCTGAAGTCCCCGGATTT | 3513 |
| | TCTGGAGGTGCGATGGC | 3514 |
| | GCCATCGCACCTCCAGA | 3515 |
| Hypercholesterolaemia Cys68Trp TGCg-TGG | ATCCGGGGACTTCAGCTGTGGGGCCGTGTCAACCGCTGCA TTCCTCAGTTCTGGAGGTGCGATGGCCAAGTGGACTGCGACA ACGGCTCAGACGAGCAAGGCTGTCGTAAGTGTGGCCCT | 3516 |
| | AGGGCCACACTTACGACAGCCTTGCTCGTCTGAGCCGTTGTC GCAGTCCACTTGGCCATCGCACCTCCAGAACTGAGGAATGCA GCGGTTGACACGGCCCCCACAGCTGAAGTCCCCGGAT | 3517 |
| | TGGAGGTGCGATGGCCA | 3518 |
| | TGGCCATCGCACCTCCA | 3519 |
| Hypercholesterolaemia Cys68Tyr TGC-TAC | AATCCGGGGACTTCAGCTGTGGGGCCGTGTCAACCGCTGC ATTCCTCAGTTCTGGAGGTGCGATGGCCAAGTGGACTGCGAC AACGGCTCAGACGAGCAAGGCTGTCGTAAGTGTGGCCC | 3520 |
| | GGGCCACACTTACGACAGCCTTGCTCGTCTGAGCCGTTGTC GCAGTCCACTTGGCCATCGCACCTCCAGAACTGAGGAATGCA GCGGTTGACACGGCCCCCACAGCTGAAGTCCCCGGATT | 3521 |
| | CTGGAGGTGCGATGGCC | 3522 |
| | GGCCATCGCACCTCCAG | 3523 |
| Hypercholesterolaemia Asp69Asn cGAT-AAT | TCCGGGGACTTCAGCTGTGGGGCCGTGTCAACCGCTGCAT TCCTCAGTTCTGGAGGTGCGATGGCCAAGTGGACTGCGACA ACGGCTCAGACGAGCAAGGCTGTCGTAAGTGTGGCCCTG | 3524 |
| | CAGGGCCACACTTACGACAGCCTTGCTCGTCTGAGCCGTTGT CGCAGTCCACTTGGCCATCGCACCTCCAGAACTGAGGAATG CAGCGGTTGACACGGCCCCCACAGCTGAAGTCCCCGGA | 3525 |
| | GGAGGTGCGATGGCCAA | 3526 |
| | TTGGCCATCGCACCTCC | 3527 |
| Hypercholesterolaemia Asp69Gly GAT-GGT | CCGGGGACTTCAGCTGTGGGGCCGTGTCAACCGCTGCATT CCTCAGTTCTGGAGGTGCGATGGCCAAGTGGACTGCGACAA CGGCTCAGACGAGCAAGGCTGTCGTAAGTGTGGCCCTGC | 3528 |
| | GCAGGGCCACACTTACGACAGCCTTGGTCGTCTGAGCCGTT GTCGCAGTCCACTTGGCCATCGCACCTCCAGAACTGAGGAAT GCAGCGGTTGACACGGCCCCCACAGCTGAAGTCCCCGG | 3529 |
| | GAGGTGCGATGGCAAG | 3530 |
| | CTTGGCCATCGCACCTC | 3531 |
| Hypercholesterolaemia Asp69Tyr cGAT-TAT | TCCGGGGACTTCAGCTGTGGGGCCGTGTCAACCGCTGCAT TCCTCAGTTCTGGAGGTGCGATGGCCAAGTGGACTGCGACA ACGGCTCAGACGAGCAAGGCTGTCGTAAGTGTGGCCCTG | 3532 |
| | CAGGGCCACACTTACGACAGCCTTGCTCGTCTGAGCCGTTGT CGCAGTCCACTTGGCCATCGCACCTCCAGAACTGAGGAATG CAGCGGTTGACACGGCCCCCACAGCTGAAGTCCCCGGA | 3533 |
| | GGAGGTGCGATGGCCAA | 3534 |
| | TTGGCCATCGCACCTCC | 3535 |
| Hypercholesterolaemia Gln71Glu | GACTTCAGCTGTGGGGCCGTGTCAACCGCTGCATTCCTCA GTTCTGGAGGTGCGATGGCCAAGTGGACTGCGACAACGGCT | 3536 |

TABLE 28-continued

LDLR Mutations and Genome-Correcting Oligos

| Clinical Phenotype & Mutation | Correcting Oligos | SEQ ID NO: |
|---|---|---|
| cCAA-GAA | CAGACGAGCAAGGCTGTCGTAAGTGTGGCCCTGCCTTTG | |
| | CAAAGGCAGGGCCACACTTACGACAGCCTTGCTCGTCTGAG CCGTTGTCGCAGTCCACTTGGCCATCGCACCTCCAGAACTGA GGAATGCAGCGGTTGACACGGCCCCCACAGCTGAAGTC | 3537 |
| | GCGATGGCCAAGTGGAC | 3538 |
| | GTCCACTTGGCCATCGC | 3539 |
| Hypercholesterolaemia Cys74Gly cTGC-GGC | TGTGGGGGCCGTGTCAACCGCTGCATTCCTCAGTTCTGGAG GTGCGATGGCCAAGTGGACTGCGACAACGGCTCAGACGAGC AAGGCTGTCGTAAGTGTGGCCCTGCCTTTGCTATTGAGC | 3540 |
| | GCTCAATAGCAAAGGCAGGGCCACACTTACGACAGCCTTGCT CGTCTGAGCCGTTGTCGCAGTCCACTTGGCCATCGCACCTC CAGAACTGAGGAATGCAGCGGTTGACACGGCCCCCACA | 3541 |
| | AAGTGGACTGCGACAAC | 3542 |
| | GTTGTCGCAGTCCACTT | 3543 |
| Hypercholesterolaemia Ser78Term TCA-TGA | TCAACCGCTGCATTCCTCAGTTCTGGAGGTGCGATGGCCAAG TGGACTGCGACAACGGCTCAGACGAGCAAGGCTGTCGTAAG TGTGGCCCTGCGTTTGCTATTGAGCCTATCTGAGTCCT | 3544 |
| | AGGACTCAGATAGGCTCAATAGCAAAGGCAGGGCCACACTTA CGACAGCCTTGCTCGTCTGAGCCGTTGTCGCAGTCCACTTGG CCATCGCACCTCCAGAACTGAGGAATGCAGCGGTTGA | 3545 |
| | CAACGGCTCAGACGAGC | 3546 |
| | GCTCGTCTGAGCCGTTG | 3547 |
| Hypercholesterolaemia Glu80Lys cGAG-AAG | CGCTGCATTCCTCAGTTCTGGAGGTGCGATGGCCAAGTGGA CTGCGACAACGGCTCAGACGAGCAAGGCTGTCGTAAGTGTG GCCCTGCCTTTGCTATTGAGCCTATCTGAGTCCTGGGGA | 3548 |
| | TCCCCAGGACTCAGATAGGCTCAATAGCAAAGGCAGGGCCA CACTTACGACAGCCTTGCTCGTCTGAGCCGTTGTCGCAGTCC ACTTGGCCATCGCACCTCCAGAACTGAGGAATGCAGCG | 3549 |
| | GCTCAGACGAGCAAGGC | 3550 |
| | GCCTTGCTCGTCTGAGC | 3551 |
| Hypercholesterolaemia GTu80Term cGAG-TAG | CGCTGCATTCCTCAGTTCTGGAGGTGCGATGGCCAAGTGGA CTGCGACAACGGCTCAGACGAGCAAGGCTGTCGTAAGTGTG GCCCTGCCTTTGCTATTGAGCCTATCTGAGTCCTGGGGA | 3552 |
| | TCCCCAGGACTCAGATAGGCTCAATAGCAAAGGCAGGGCCA CACTTACGACAGCCTTGCTCGTCTGAGCCGTTGTCGCAGTCC ACTTGGCCATCGCACCTCCAGAACTGAGGAATGCAGCG | 3553 |
| | GCTCAGACGAGCAAGGC | 3554 |
| | GCCTTGCCTCGTCTGAGC | 3555 |
| Hypercholesterolaemia Gln81Term gCAA-TAA | TGCATTCCTCAGTTCTGGAGGTGCGATGGCCAAGTGGACTGC GACAACGGCTCAGACGAGCAAGGCTGTCGTAAGTGTGGCCC TGCCTTTGCTATTGAGCCTATCTGAGTCCTGGGGAGTG | 3556 |
| | CACTCCCCAGGACTCAGATAGGCTCAATAGCAAAGGCAGGG CCACACTTACGACAGCCTTGCTCGTCTGAGCCGTTGTCGCAG TCCACTTGGCCATCGCACCTCCAGAACTGAGGAATGCA | 3557 |
| | CAGACGAGCAAGGCTGT | 3558 |
| | ACAGCCTTGCTCGTCTG | 3559 |
| Hypercholesterolaemia Cys88Arg gTGC-CGC | TGGGAGACTTCACACGGTGATGGTGGTCTCGGCCCATCCAT CCCTGCAGCCCCCAAGACGTGCTCCCAGGACGAGTTTCGCT GCCACGATGGGAAGTGCATCTCTCGGCAGTTCGTCTGTG | 3560 |

TABLE 28-continued

LDLR Mutations and Genome-Correcting Oligos

| Clinical Phenotype & Mutation | Correcting Oligos | SEQ ID NO: |
|---|---|---|
| | CACAGACGAACTGCCGAGAGATGCAGTTCCCATCGTGGCAG CGAAACTCGTCCTGGGAGCACGTCTTGGGGGCTGCAGGGAT GGATGGGCCGAGACCACCATCACCGTGTGAAGTCTCCCA | 3561 |
| | CCAAGACGTGCTCCCAG | 3562 |
| | CTGGGAGCACGTCTTGG | 3563 |
| Hypercholesterolaemia Glu92Term cGAG-TAG | CACGGTGATGGTGGTCTCGGCCCATCCATCCCTGCAGCCCC CAAGACGTGCTCCCAGGACGAGTTTCGCTGCCACGATGGGA AGTGCATCTCTCGGCAGTTCGTCTGTGACTCAGACCGGG | 3564 |
| | CCCGGTCTGAGTCACAGACGAACTGCCGAGAGATGCACTTC CATCGTGGCAGCGTAAACTCGTCCTGGGAGCACGTCTTGGG GGCTGCAGGGATGGATGGGCCGAGACCACCATCACCGTG | 3565 |
| | CCCAGGACGAGTTFCGC | 3566 |
| | GCGAAACTCGTCCTGGG | 3567 |
| Hypercholesterolaemia Cys95Arg cTGC-CGC | GGTGGTCTCGGCCCATCCATCCCTGCAGCCCCAAGACGTG CTCCCAGGACGAGTTTCGCTGCCACGATGGGAAGTGCATCT CTCGGCAGTTCGTCTGTGACTCAGACCGGGACTGCTTGG | 3568 |
| | CCAAGCAGTCCCGGTCTGAGTCACAGACGAACTGCCGAGAG ATGCACTTCCCATCGTGGCAGCGAAACTCGTCCTGGGAGCA CGTCTTGGGGGCTGCAGGGATGGATGGGCCGAGACCACC | 3569 |
| | AGTTTCGCTGCCACGAT | 3570 |
| | ATCGTGGCAGCGAAACT | 3571 |
| Hypercholesterolaemia Asp91Tyr cGAT-TAT | CTCGGCCCATCCATCCCTGCAGCCCCAAGACGTGCTCCCA GGACGAGTTTCGCTGCCACGATGGGAAGTGCATCTCTCGGC AGTTCGTCTGTGACTCAGACCGGGACTGCTTGGACGGCT | 3572 |
| | AGCCGTCCAAGCAGTCCCGGTCTGAGTCACAGACGAACTGC CGAGAGATGCACTTCCCATCGTGGCAGCGAAACTCGTCCTG GGAGCACGTCTTGGGGGCTGCAGGGATGGATGGGCCGAG | 3573 |
| | GCTGCCACGATGGGAAG | 3574 |
| | CTTCCCATCGTGGCAGC | 3575 |
| Hypercholesterolaemia Trp(-12)Arg cTGG-AGG | GGGTCGGGACACTGCCTGGCAGAGGCTGCGAGCATGGGGC CCTGGGGCTGGAAATTGCGCTGGACCGTCGCCTTGCTCCTC GCCGCGGCGGGGACTGCAGGTAAGGCTTGCTCCAGGCGCC | 3576 |
| | GGCGCCTGGAGCAAGCCTTACCTGCAGTCCCCGCCGCGGC GAGGAGCAAGGCGACGGTCCAGCGCAATTCCAGCCCCAGG GCCCCATGCTCGCAGCCTCTGCCAGGCAGTGTCCCGACCC | 3577 |
| | AATTGCGCTGGACCGTC | 3578 |
| | GACGGTCCAGCGCAATT | 3579 |
| Hypercholesterolaemia Trp(-18)Term TGGg-TGA | CAGCAGGTCGTGATCCGGGTCGGGACACTGCCTGGCAGAGG CTGCGAGCATGGGGCCCTGGGGCTGGAAATTGCGCTGGACC GTCGCCTTGCTCCTCGCCGCGGCGGGGACTGCAGGTAAG | 3580 |
| | CTTACCTGCAGTCCCCGCCGCGGCGAGGAGCAAGGCGACG GTCCAGCGCAATTTCCAGCCCCAGGGCCCCATGCTCGCAGC CTCTGCCAGGCAGTGTCCCGACCCGGATCACGACCTGCTG | 3581 |
| | GGGCCCTGGGGCTGGAA | 3582 |
| | TTCCAGCCCCAGGGCCC | 3583 |
| Hypercholesterolaemia Met(-21)Leu cATG-TTG | CAGCTAGGACACAGCAGGTCGTGATCCGGGTCGGGACACTG CCTGGCAGAGGCTGCGAGCATGGGGCCCTGGGGCTGG TTGCGCTGGACCGTCGCCTTGCTCCTCGCCGCGGCGGGGA | 3584 |
| | TCCCCGCCGCGGCGAGGAGCAAGGCGACGGTCCAGCGCAA TTTCCAGCCCCAGGGCCCCATTGCTCGCAGCCTCTGCCAGGC | 3585 |

TABLE 28-continued

LDLR Mutations and Genome-Correcting Oligos

| Cilnical Phenotype & Mutation | Correcting Oligos | SEQ ID NO: |
|---|---|---|
| | AGTGTGCCGACCCGGATCACGACCTGCTGTGTCCTAGCTG | |
| | CTGCGAGCATGGGGCCC | 3586 |
| | GGGCCCCATGCTCGCAG | 3587 |
| Hypercholesterolaemia Met(-21)Val cATG-GTG | CAGCTAGGACACAGCAGGTCGTGATCCGGGTCGGGACACTG CCTGGCAGAGGCTGCGAGCATGGGGCCCTGGGGCTGG TTGCGCTGGACCGTCGCCTTGCTCCTCGCCGCGGCGGGGA | 3588 |
| | TCCCCGCCGCGGCGAGGAGCAAGGCGACGGTCCAGCGCAA TTTCCAGCCCCAGGGCCCCATGCTCGCAGCCTCTGCCAGGC AGTGTCCCGACCCGGATCACGACCTGCTGTGTCCTAGCTG | 3589 |
| | CTGCGAGCATGGGGCCC | 3590 |
| | GGGCCCCATGCTCGCAG | 3591 |
| Hypercholesterolaemia Ile101Phe cATC-TTC | ATCCCTGCAGCCCCCAAGACGTGCTCCCAGGACGAGTTTCG CTGCCACGATGGGAAGTGCATCTCTCGGCAGTTCGTCTGTGA CTCAGACCGGGACTGCTTGGACGGCTCAGACGAGGCCT | 3592 |
| | AGGCCTCGTCTGAGCCGTCCAAGCAGTCCCGGTCTGAGTCA CAGACGAACTGCCGAGAGATGCACTTCCCATCGTGGCAGCG AAACTCGTCCTGGGAGCACGTCTTGGGGGCTGCAGGGAT | 3593 |
| | GGAAGTGCATCTCTCGG | 3594 |
| | CCGAGAGATGCACTTCC | 3595 |
| Hypercholesterolaemia Gln104Term gCAG-TAG | GCCCCCAAGACGTGCTCCCAGGACGAGTTTCGCTGCCACGA TGGGAAGTGCATCTCTCGGCAGTTCGTCTGTGACTCAGACCG GGACTGCTTGGACGGCTCAGACGAGGCCTCCTGCCCGG | 3596 |
| | CCGGGCAGGAGGCCTCGTCTGAGCCGTCCAAGCAGTCCCG GTCTGAGTCACAGACGAACTGCCGAGAGATGCACTTCCCATC GTGGCAGCGAAACTCGTCCTGGGAGCACGTCTTGGGGGC | 3597 |
| | TCTCTCGGCAGTTCGTC | 3598 |
| | GACGAACTGCCGAGAGA | 3599 |
| Hypercholesterolaemia Cys113Arg cTGC-CGC | TTFCGCTGCCACGATGGGAAGTGCATCTCTCGGCAGTTCGTC TGTGACTCAGACCGGGACTGCTTGGACGGCTCAGACGAGGC CTCCTGCCCGGTGCTCACCTGTGGTCCCGCCAGCTTCC | 3600 |
| | GGAAGCTGGCGGGACCACAGGTGAGCACCGGGCAGGAGGC CTCGTCTGAGCCGTCCAAGCAGTCCCGGTCTGAGTCACAGA CGAACTGCCGAGAGATGCACTTCCCATCGTGGCAGCGAAA | 3601 |
| | ACCGGGACTGCTTGGAC | 3602 |
| | GTCCAAGCAGTCCCGGT | 3603 |
| Hypercholesterolaemia Glu119Lys cGAG-AAG | AAGTGCATCTCTCGGCAGTTCGTCTGTGACTCAGACCGGGAC TGCTTGGACGGCTCAGACGAGGCCTCCTGCCCGGTGCTCAC CTGTGGTCCCGCCAGCTTCCAGTGCAACAGCTCCACCT | 3604 |
| | AGGTGGAGCTGTTGCACTGGAAGCTGGCGGGACCACAGGTG AGCACCGGGCAGGAGGCCTCGTCTGAGCCGTCCATTAGCAGTC CCGGTCTGAGTCACAGACGAACTGCCGAGAGATGCACTT | 3605 |
| | GCTCAGACGAGGCCTCC | 3606 |
| | GGAGGCCTCGTCTGAGC | 3607 |
| Hypercholesterolaemia Glu119Term cGAG-TAG | AAGTGCATCTCTCGGCAGTTCGTCTGTGACTCAGACCGGGAC TGCTTGGACGGCTCAGACGAGGCCTCCTGCCCGGTGCTCAC CTGTGGTCCCGCCAGCTTCCAGTGCAACAGCTCCACCT | 3608 |
| | AGGTGGAGCTGTTGCACTGGAAGCTGGCGGGACCACAGGTG AGCACCGGGCAGGAGGCCTCGTCTGAGCCGTCCAAGCAGTC CCGGTCTGAGTCACAGACGAACTGCCGAGAGATGCACTT | 3609 |

TABLE 28-continued

LDLR Mutations and Genome-Correcting Oligos

| Clinical Phenotype & Mutation | Correcting Oligos | SEQ ID NO: |
|---|---|---|
| | GCTCAGACGAGGCCTCC | 3610 |
| | GGAGGCCTCGTCTGAGC | 3611 |
| Hypercholesterolaemia Cys122Term TGCc-TGA | TCGGCAGTTCGTCTGTGACTCAGACCGGGACTGCTTGGACG GCTCAGACGAGGCCTCCTGCCCGGTGCTCACCTGTGGTCCC GCCAGCTFCCAGTGCAACAGCTCCACCTGCATCCCCCAG | 3612 |
| | CTGGGGGATGCAGGTGGAGCTGTTGCACTGGAAGCTGGCGG GACCACAGGTGAGCACCGGGCAGGAGGCCTCGTCTGAGCC GTCCAAGCAGTCCCGGTCTGAGTCACAGACGAACTGCCGA | 3613 |
| | GCCTCCTGCCCGGTGCT | 3614 |
| | AGCACCGGGCAGGAGGC | 3615 |
| Hypercholesterolaemia Cys127Trp TGTg-TGG | TGACTCAGACCGGGACTGCTTGGACGGCTCAGACGAGGCCT CCTGCCCGGTGCTCACCTGTGGTCCCGCCAGCTTCCAGTGC AACAGCTCCACCTGCATCCCCAGCTGTGGGCCTGCGAC | 3616 |
| | GTCGCAGGCCCACAGCTGGGGGATGCAGGTGGAGCTGTTGC ACTGGAAGCTGGCGGGACCACAGGTGAGCACCGGGCAGGA GGCCTCGTCTGAGCCGTCCAAGCAGTCCCGGTCTGAGTCA | 3617 |
| | CTCACCTGTGGTCCCGC | 3618 |
| | GCGGGACCACAGGTGAG | 3619 |
| Hypercholesterolaemia Gln133Term cCAG-TAG | TGCTTGGACGGCTCAGACGAGGCCTCCTGCCCGGTGCTCAC CTGTGGTCCCGCCAGCTTCCAGTGCAACAGCTCCACCTGCAT CCCCCAGCTGTGGGCCTGCGACAACGACCCCGACTGCG | 3620 |
| | CGCAGTCGGGGTCGTTGTCGCAGGCCCACAGCTGGGGGAT GCAGGTGGAGCTGTTGCACTGGAAGCTGGCGGGACCACAGG TGAGCACCGGGCAGGAGGCCTCGTCTGAGCCGTCCAAGCA | 3621 |
| | CCAGCTTCCAGTGCAAC | 3622 |
| | GTTGCACTGGAAGCTGG | 3623 |
| Hypercholesterolaemia Cys134Gly gTGC-GGC | TTGGACGGCTCAGACGAGGCCTCCTGCCCGGTGCTCACCTG TGGTCCCGCCAGCTTCCAGTGCAACAGCTCCACCTGCATCC CCCAGCTGTGGGCCTGCGACAACGACCCCGACTGCGAAG | 3624 |
| | CTTCGCAGTCGGGGTCGTTGTCGCAGGCCCACAGCTGGGGG ATGCAGGTGGAGCTGTTGCACTGGAAGCTGGCGGGACCACA GGTGAGCACCGGGCAGGAGGCCTCGTCTGAGCCGTCCAA | 3625 |
| | GCTTCCAGTGCAACAGC | 3626 |
| | GCTGTTGCACTGGAAGC | 3627 |
| Hypercholesterolaemia Cys139Gly cTGC-GGC | GAGGCCTCCTGCCCGGTGCTCACCTGTGGTCCCGCCAGCTT CCAGTGCAACAGCTCCACCTGCATCCCCCAGCTGTGGGCCT GCGACAACGACCCCGACTGCGAAGATGGCTCGGATGAGT | 3628 |
| | ACTCATCCGAGCCATCTTCGCAGTCGGGGTCGTTGTCGCAG GCCCACAGCTGGGGGATGCAGGTGGAGCTGTTGCACTGGAA GCTGGCGGGACCACAGGTGAGCACCGGGCAGGAGGCCTC | 3629 |
| | GCTCCACCTGCATCCCC | 3630 |
| | GGGGATGCAGGTGGAGC | 3631 |
| Hypercholesterolaemia Cys139Tyr TGC-TAC | AGGCCTCCTGCCCGGTGCTCACCTGTGGTCCCGCCAGCTTC CAGTGCAACAGCTCCACCTGCATCCCCCAGCTGTGGGCCTG CGACAACGACCCCGACTGCGAAGATGGCTCGGATGAGTG | 3632 |
| | CACTCATCCGAGCCATCTTCGCAGTCGGGGTCGTTGTCGCA GGCCCACAGCTGGGGGATGCAGGTGGAGCTGTTGCACTGGA AGCTGGCGGGACCACAGGTGAGCACCGGGCAGGAGGCCT | 3633 |
| | CTCCACCTGCATCCCCC | 3634 |
| | GGGGGATGCAGGTGGAG | 3635 |

TABLE 28-continued

LDLR Mutations and Genome-Correcting Oligos

| Clinical Phenotype & Mutation | Correcting Oligos | SEQ ID NO: |
|---|---|---|
| Hypercholesterolaemia Cys146Term TGCg-TGA | CTGTGGTCCCGCCAGCTTCCAGTGCAACAGCTCCACCTGCAT CCCCCAGCTGTGGGCCTGCGACAACGACCCCGACTGCGAAG ATGGCTCGGATGAGTGGCCGCAGCGCTGTAGGGGTCTT | 3636 |
| | AAGACCCCTACAGCGCTGCGGCCACTCATCCGAGCCATCTTC GCAGTCGGGGTCGTTGTCGCAGGCCCACAGCTGGGGGATG CAGGTGGAGCTGTTGCACTGGAAGCTGGCGGGACCACAG | 3637 |
| | TGGGCCTGCGACAACGA | 3638 |
| | TCGTTGTCGCAGGCCCA | 3639 |
| Hypercholesterolaemia Asp147Asn cGAC-AAC | TGTGGTCCCGCCAGCTTCCAGTGCAACAGCTCCACCTGCATC CCCCAGCTGTGGGCCTGCGACAACGACCCCGACTGCGAAGA TGGCTCGGATGAGTGGCCGCAGCGCTGTAGGGGTCTTT | 3640 |
| | AAAGACCCCTACAGCGCTGCGGCCACTCATCCGAGCCATCTT CGCAGTCGGGGTCGTTGTCGCAGGCCCACAGCTGGGGGAT GCAGGTGGAGCTGTTGCACTGGAAGCTGGCGGGACCACA | 3641 |
| | GGGCCTGCGACAACGAC | 3642 |
| | GTCGTTGTCGCAGGCCC | 3643 |
| Hypercholesterolaemia Asp147His cGAC-CAC | TGTGGTCCCGCCAGCTTCCAGTGCAACAGCTCCACCTGCATC CCCCAGCTGTGGGCCTGCGACAACGACCCCGACTGCGAAGA TGGCTCGGATGAGTGGCCGCAGCGCTGTAGGGGTCTTT | 3644 |
| | AAAGACCCCTACAGCGCTGCGGCCACTCATCCGAGCCATCTT CGCAGTCGGGGTCGTTGTCGCAGGCCCACAGCTGGGGGAT GCAGGTGGAGCTGTTGCACTGGAAGCTGGCGGGACCACA | 3645 |
| | GGGCCTGCGACAACGAC | 3646 |
| | GTCGTTGTCGCAGGCCC | 3647 |
| Hypercholesterolaemia Asp147Tyr cGAC-TAC | TGTGGTCCCGCCAGCTTCCAGTGCAACAGCTCCACCTGCATC CCCCAGCTGTGGGCCTGCGACAACGACCCCGACTGCGAAGA TGGCTCGGATGAGTGGCCGCAGCGCTGTAGGGGTCTTT | 3648 |
| | AAAGACCCCTACAGCGCTGCGGCCACTCATCCGAGCCATCTT CGCAGTCGGGGTCGTTGTCGCAGGCCCACAGCTGGGGGAT GCAGGTGGAGCTGTTGCACTGGAAGCTGGCGGGACCACA | 3649 |
| | GGGCCTGCGACAACGAC | 3650 |
| | GTCGTTGTCGCAGGCCC | 3651 |
| Hypercholesterolaemia Cys152Arg cTGC-CGC | TTCCAGTGCAACAGCTCCACCTGCATCCCCCAGCTGTGGGC CTGCGACAACGACCCCGACTGCGAAGATGGCTCGGATGAGT GGCCGCAGCGCTGTAGGGGTCTTTACGTGTTCCAAGGGG | 3652 |
| | CCCCTTGGAACACGTAAAGACCCCTACAGCGCTGCGGCCAC TCATCCGAGCCATCTTCGCAGTCGGGGTCGTTGTCGCAGGC CCACAGCTGGGGGATGCAGGTGGAGCTGTTGCACTGGAA | 3653 |
| | ACCCCGACTGCGAAGAT | 3654 |
| | ATCTTCGCAGTCGGGGT | 3655 |
| Hypercholesterolaemia Cys152Gly cTGC-GGC | TTCCAGTGCAACAGCTCCACCTGCATGCCCCAGCTGTGGGC CTGCGACAACGACCCCGACTGCGAAGATGGCTCGGATGAGT GGCCGCAGCGCTGTAGGGGTCTTTACGTGTTCCAAGGGG | 3656 |
| | CCCCTTGGAACACGTAAAGACCCCTACAGCGCTGCGGCCAC TCATCCGAGCCATCTTCGCAGTCGGGGTCGTTGTCGCAGGC CCACAGCTGGGGGATGCAGGTGGAGCTGTTGCACTGGAA | 3657 |
| | ACCCCGACTGCGAAGAT | 3658 |
| | ATCTTCGCAGTCGGGGT | 3659 |
| Hypercholesterolaemia Cys152Trp | CCAGTGCAACAGCTCCACCTGCATCCCCCAGCTGTGGGCCT GCGACAACGACCCCGACTGCGAAGATGGCTCGGATGAGTGG | 3660 |

TABLE 28-continued

LDLR Mutations and Genome-Correcting Oligos

| Cilnical Phenotype & Mutation | Correcting Oligos | SEQ ID NO: |
|---|---|---|
| TGCg-TGG | CCGCAGCGCTGTAGGGGTCTTTACGTGTTCCAAGGGGAC | |
| | GTCCCCTFGGAACACGTAAAAGACCCCTACAGCGCTGCGGCC ACTCATCCGAGCCATCTTCGCAGTCGGGGTCGTTGTCGCAG GCCCACAGCTGGGGGATGCAGGTGGAGCTGTTGCACTGG | 3661 |
| | CCCGACTGCGAAGATGG | 3662 |
| | CCATCTTCGCAGTCGGG | 3663 |
| Hypercholesterolaemia Asp154Asn aGAT-AAT | TGCAACAGCTCCACCTGCATCCCCCAGCTGTGGGCCTGCGA CAACGACCCCGACTGCGAAGATGGCTCGGATGAGTGGCCGC AGCGCTGTAGGGGTCTTTACGTGTTCCAAGGGGACAGTA | 3664 |
| | TACTGTCCCCTTGGAACACGTAAAGACCCCTACAGCGCTGCG GCCACTCATCCGAGCCATCTTCGCAGTCGGGGTCGTTGTCG CAGGCCCACAGCTGGGGGATGCAGGTGGAGCTGTTGCA | 3665 |
| | ACTGCGAAGATGGCTCG | 3666 |
| | CGAGCCATCTTCGCAGT | 3667 |
| Hypercholesterolaemia Ser156Leu TCG-HG | GCTCCACCTGCATCCCCCAGCTGTGGGCCTGCGACAACGAC CCCGACTGCGAAGATGGCTCGGATGAGTGGCCGCAGCGCTG TAGGGGTCTTFACGTGTTCCAAGGGGACAGTAGCCCCTG | 3668 |
| | CAGGGGCTACTGTCCCCTTGGAACACGTAAAGACCCCTACAG CGCTGCGGCCACTCATCCGAGCCATCTTCGCAGTCGGGGTC GTTGTCGCAGGCCCACAGCTGGGGGATGCAGGTGGAGC | 3669 |
| | AGATGGCTCGGATGAGT | 3670 |
| | ACTCATCCGAGCCATCT | 3671 |
| Hypercholesterolaemia Cys163Tyr TGT-TAT | TGTGGGCCTGCGACAACGACCCCGACTGCGAAGATGGCTCG GATGAGTGGCCGCAGCGCTGTAGGGGTCTTTACGTGTTCCAA GGGGACAGTAGCCCCTGCTCGGCCTTCGAGTTCCACTG | 3672 |
| | CAGTGGAACTCGAAGGCCGAGCAGGGGCTACTGTCCCCTTG GAACACGTAAAGACCCCTACAGCGCTGCGGCCACTCATCCG AGCCATCTTCGCAGTCGGGGTCGTTGTCGCAGGCCCACA | 3673 |
| | GCAGCGCTGTAGGGGTC | 3674 |
| | GACCCCTACAGCGCTGC | 3675 |
| Hypercholesterolaemia Tyr167Term TACg-TAG | CAACGACCCCGACTGCGAAGATGGCTCGGATGAGTGGCCGC AGCGCTGTAGGGGTCTTTACGTGTTCCAAGGGGACAGTAGC CCCTGCTCGGCCTTCGAGTTCCACTGCCTAAGTGGCGAG | 3676 |
| | CTCGCCACTTAGGCAGTGGAACTCGAAGGCCGAGCAGGGGC TACTGTCCCCTTGGAACACGTAAAGACCCCTACAGCGCTGCG GCCACTCATCCGAGCCATCTTCGCAGTCGGGGTCGTTG | 3677 |
| | GGTCTTTACGTGTTCCA | 3678 |
| | TGGAACACGTAAAGACC | 3679 |
| Hypercholesterolaemia Gln170Term cCAA-TAA | CCCGACTGCGAAGATGGCTCGGATGAGTGGCCGCAGCGCTG TAGGGGTCTTTACGTGTTCCAAGGGGACAGTAGCCCCTGCTC GGCCHCGAGTTCCACTGCCTAAGTGGCGAGTGCATCC | 3680 |
| | GGATGCACTCGCCACTTAGGCAGTGGAACTCGAAGGCCGAG CAGGGGCTACTGTCCCCTTGGAACACGTAAAGACCCCTACAG CGCTGCGGCCACTCATCCGAGCCATCTTCGCAGTCGGG | 3681 |
| | ACGTGTTCCAAGGGGAC | 3682 |
| | GTCCCCTTGGAACACGT | 3683 |
| Hypercholesterolaemia Cys176Phe TGC-TTC | CGGATGAGTGGCCGCAGCGCTGTAGGGGTCTTTACGTGTTC CAAGGGGACAGTAGCCCCTGCTCGGCCTTCGAGTTCCACTG CCTAAGTGGCGAGTGCATCCACTCCAGCTGGCGCTGTGA | 3684 |

TABLE 28-continued

LDLR Mutations and Genome-Correcting Oligos

| Clinical Phenotype & Mutation | Correcting Oligos | SEQ ID NO: |
|---|---|---|
| | TCACAGCGCCAGCTGGAGTGGATGCACTCGCCACTTAGGCA GTGGAACTCGAAGGCCGAGCAGGGGCTACTGTCCCCTTGGA ACACGTAAAGACCCCTACAGCGCTGCGGCCACTCATCCG | 3685 |
| | TAGCCCCTGCTCGGCCT | 3686 |
| | AGGCCGAGCAGGGGCTA | 3687 |
| Hypercholesterolaemia Cys176Tyr TGC-TAC | CGGATGAGTGGCCGCAGCGCTGTAGGGGTCTTTACGTGTTC CAAGGGGACAGTAGCCCCTGCTCGGCCTTCGAGTTCCACTG CCTAAGTGGCGAGTGCATCCACTCCAGCTGGCGCTGTGA | 3688 |
| | TCACAGCGCCAGCTGGAGTGGATGCACTCGCCACTTAGGCA GTGGAACTCGAAGGCCGAGCAGGGGCTACTGTCCCCTTGGA ACACGTAAAGACCCCTACAGCGCTGCGGCCACTCATCCG | 3689 |
| | TAGCCCCTGCTCGGCCT | 3690 |
| | AGGCCGAGCAGGGGCTA | 3691 |
| Hypercholesterolaemia Ser177Leu TCG-TTG | ATGAGTGGCCGCAGCGCTGTAGGGGTCTTTACGTGTTCCAAG GGGACAGTAGCCCCTGCTCGGCCTTCGAGTTCCACTGCCTA AGTGGCGAGTGCATCCACTCCAGCTGGCGCTGTGATGG | 3692 |
| | CCATCACAGCGCCAGCTGGAGTGGATGCACTCGCCACTTAG GCAGTGGAACTCGAAGGCCGAGCAGGGGCTACTGTCCCCTT GGAACACGTAAAGACCCCTACAGCGCTGCGGCCACTCAT | 3693 |
| | CCCCTGCTCGGCCTTCG | 3694 |
| | CGAAGGCCGAGCAGGGG | 3695 |
| Hypercholesterolaemia Glu187Lys cGAG-AAG | TACGTGTTCCAAGGGGACAGTAGCCCCTGCTCGGCCTTCGA GTTCCACTGCCTAAGTGGCGAGTGCATCCACTCCAGCTGGC GCTGTGATGGTGGCCCCGACTGCAAGGACAAATCTGACG | 3696 |
| | CGTCAGATTTGTCCTTGCAGTCGGGGCCACCATCACAGCGC CAGCTGGAGTGGATGCACTCGCCACTTAGGCAGTGGAACTC GAAGGCCGAGCAGGGGCTACTGTCCCCTTGGAACACGTA | 3697 |
| | TAAGTGGCGAGTGCATC | 3698 |
| | GATGCACTCGCCACTTA | 3699 |
| Hypercholesterolaemia His190Tyr cCAC-TAC | CAAGGGGACAGTAGCCCCTGCTCGGCCTTCGAGTTCCACTG CCTPAGTGGCGAGTGCATCCACTCCCAGCTGGCGCTGTGATG GTGGCCCCGACTGCAAGGACAAATCTGACGAGGAAAACT | 3700 |
| | AGTTTTCCTCGTCAGATTTGTCCTTGCAGTCGGGGCCACCAT CACAGCGCCAGCTGGAGTGGATGCACTCGCCACTTAGGCAG TGGAACTCGAAGGCCGAGCAGGGGCTACTGTCCCCTTG | 3701 |
| | AGTGCATCCACTCCAGC | 3702 |
| | GCTGGAGTGGATGCACT | 3703 |
| Hypercholesterolaemia Gly198Asp GGC-GAC | CCTTCGAGTFCCACTGCCTAAGTGGCGAGTGCATCCACTCCA GCTGGCGCTGTGATGGTGGCCCCGACTGCAAGGACAAATCT GACGAGGAAAACTGCGGTATGGGCGGGGCCAGGGTGGG | 3704 |
| | CCCACCCTGGCCCCGCCCATACCGCAGTTTTCCTCGTCAGAT TTGTCCTTGCAGTCGGGGCCACCATCACAGCGCCAGCTGGA GTGGATGCACTCGCCACTTAGGCAGTGGAACTCGAAGG | 3705 |
| | TGATGGTGGCCCCGACT | 3706 |
| | AGTCGGGGCCACCATCA | 3707 |
| Hypercholesterolaemia Asp200Asn cGAC-AAC | GAGTTCCACTGCCTAAGTGGCGAGTGCATCCAGTCCAGCTG GCGCTGTGATGGTGGCCCCGACTGCAAGGACAAATCTGACG AGGAAAACTGCGGTATGGGCGGGGCCAGGGTGGGGGCGG | 3708 |
| | CCGCCCCCACCCTGGCCCCGCCCATACCGCAGTTTTCCTCG TCAGATTTGTCCTTGCAGTCGGGGCCACCATCACAGCGCCAG | 3709 |

TABLE 28-continued

LDLR Mutations and Genome-Correcting Oligos

| Cilnical Phenotype & Mutation | Correcting Oligos | SEQ ID NO: |
|---|---|---|
| | CTGGAGTGGATGCACTCGCCACTTAGGCAGTGGAACTC | |
| | GTGGCCCCGACTGCAAG | 3710 |
| | CTTGCAGTCGGGGCCAC | 3711 |
| Hypercholesterolaemia Asp200Gly GAC-GGC | AGTTCCACTGCCTAAGTGGCGAGTGCATCCACTCCAGCTGGC GCTGTGATGGTGGCCCCGACTGCAAGGACAAATCTGACGAG GAAAACTGCGGTATGGGCGGGGCCAGGGTGGGGGCGGG | 3712 |
| | CCCGCCCCCACCCTGGCCCCGCCCATACCGCAGJTFTCCTC GTCAGATTTGTCCTTGCAGTCGGGGCCACCATCACAGCGCCA GCTGGAGTGGATGCACTCGCCACTTAGGCAGTGGAACT | 3713 |
| | TGGCCCCGACTGCAAGG | 3714 |
| | CCTTGCAGTCGGGGCCA | 3715 |
| Hypercholesterolaemia Asp200Tyr cGAC-TAC | GAGTTCCACTGCCTAAGTGGCGAGTGCATCCACTCCAGCTG GCGCTGTGATGGTGGCCCCGACTGCAAGGACAAATCTGACG AGGAAAACTGCGGTATGGGCGGGGCCAGGGTGGGGGCGG | 3716 |
| | CCGCCCCCACCCTGGCCCCGCCCATACCGCAGTTTFCCTCG TCAGATTTGTCCTTGCAGTGGGGGCCACCATCACAGCGCCAG CTGGAGTGGATGCACTCGCCACTTAGGCAGTGGAACTC | 3717 |
| | GTGGCCCCGACTGCAAG | 3718 |
| | CTTGCAGTCGGGGCCAC | 3719 |
| Hypercholesterolaemia Cys201Term TGCa-TGA | CCACTGCCTAAGTGGCGAGTGCATCCACTCCAGCTGGCGCT GTGATGGTGGCCCCGACTGCAAGGACAAATCTGACGAGGAA AACTGCGGTATGGGCGGGGCCAGGGTGGGGGCGGGGCGT | 3720 |
| | ACGCCCCGCCCCCACCCTGGCCCCGCCCATACCGCAGTTTT CCTCGTCAGATTTGTCCTTGCAGTCGGGGCCACCATCACAGC GCCAGCTGGAGTGGATGCACTCGCCACTTAGGCAGTGG | 3721 |
| | CCCGACTGCAAGGACAA | 3722 |
| | TTGTCCTTGCAGTCGGG | 3723 |
| Hypercholesterolaemia Cys201Tyr TGC-TAC | TCCACTGCCTAAGTGGCGAGTGCATCCACTCCAGCTGGCGC TGTGATGGTGGCCCCGACTGCAAGGACAAATCTGACGAGGA AAACTGCGGTATGGGCGGGGCCAGGGTGGGGGCGGGGCG | 3724 |
| | CGCCCCGCCCCCACCCTGGCCCCGCCCATACCGCAGTTTTC CTCGTCAGATTTGTCCTTGCAGTCGGGGCCACCATCACAGCG CCAGCTGGAGTGGATGCACTCGCCACTTAGGCAGTGGA | 3725 |
| | CCCCGACTGCAAGGACA | 3726 |
| | TGTCCTTGCAGTCGGGG | 3727 |
| Hypercholesterolaemia Asp203Asn gGAC-AAC | TGCCTAAGTGGCGAGTGCATCCACTCCAGCTGGCGCTGTGA TGGTGGCCCCGACTGCAAGGACAAATCTGACGAGGAAAACT GCGGTATGGGCGGGGCCAGGGTGGGGGCGGGGCGTCGTA | 3728 |
| | TAGGACGCCCCGCCCCCACCCTGGCCCCGCCCATACCGCA GTTTTCCTCGTCAGATTTGTCCTTGCAGTCGGGGCCACCATC ACAGCGCCAGCTGGAGTGGATGCACTCGCCACTTAGGCA | 3729 |
| | ACTGCAAGGACAAATCT | 3730 |
| | AGATTTGTCCTTGCAGT | 3731 |
| Hypercholesterolaemia Asp203Gly GAC-GGC | GCCTAAGTGGCGAGTGCATCCACTCCAGCTGGCGCTGTGAT GGTGGCCCCGACTGCAAGGACAAATCTGACGAGGAAAACTG CGGTATGGGCGGGGCCAGGGTGGGGGCGGGGCGTCCTAT | 3732 |
| | ATAGGACGCCCCGCCCCCACCCTGGCCCCGCCCATACCGCA GTTTTCCTCGTCAGATTTGTCCTTGCAGTCGGGGCCACCATC ACAGCGCCAGCTGGAGTGGATGCACTCGCCACTTAGGC | 3733 |

TABLE 28-continued

LDLR Mutations and Genome-Correcting Oligos

| Clinical Phenotype & Mutation | Correcting Oligos | SEQ ID NO: |
|---|---|---|
| | CTGCAAGGACAAATCTG | 3734 |
| | CAGATTTGTCCTTGCAG | 3735 |
| Hypercholesterolaemia Asp203Val GAC-GTC | GCCTAAGTGGCGAGTGCATCCACTCCAGCTGGCGCTGTGAT GGTGGCCCCGACTGCAAGGACAAATCTGACGAGGAAAACTG CGGTATGGGCGGGGCCAGGGTGGGGGCGGGGCGTCCTAT | 3736 |
| | ATAGGACGCCCCGCCCCCACCCTGGCCCCGCCCATACCGCA GTTTTCCTCGTCAGATTTGTCCTTGCAGTCGGGGCCACCATC ACAGCGCCAGCTGGAGTGGATGCACTCGCCACTTAGGC | 3737 |
| | CTGCAAGGACAAATCTG | 3738 |
| | CAGATTTGTCCTTGCAG | 3739 |
| Hypercholesterolaemia Ser205Pro aTCT-CCT | AGTGGCGAGTGCATCCACTCCAGCTGGCGCTGTGATGGTGG CCCCGACTGCAAGGACAAATCTGACGAGGAAAACTGCGGTAT GGGCGGGGCCAGGGTGGGGGCGGGGCGTCCTATCACCT | 3740 |
| | AGGTGATAGGACGCCCCGCCCCCACCCTGGCCCCGCCCATA CCGCAGTTTTCCTCGTCAGATTTGTCCTTGCAGTCGGGGCCA CCATCACAGCGCCAGCTGGAGTGGATGCACTCGCCACT | 3741 |
| | AGGACAAATCTGACGAG | 3742 |
| | CTGGTCAGATTTGTCCT | 3743 |
| Hypercholesterolaemia Asp206Glu GACg-GAG | CGAGTGCATCCACTCCAGCTGGCGCTGTGATGGTGGCCCCG ACTGCAAGGACAAATCTGACGAGGAAAACTGCGGTATGGGC GGGGCCAGGGTGGGGGCGGGGCGTCCTATCACCTGTCCC | 3744 |
| | GGGACAGGTGATAGGACGCCCCGCCCCCACCCTGGCCCCG CCCATACCGCAGTTTTCCTCGTCAGATTTGTCCTTGCAGTCG GGGCCACCATCACAGCGCCAGCTGGAGTGGATGCACTCG | 3745 |
| | AAATCTGACGAGGAAAA | 3746 |
| | TTTTCCTCGTCAGATTT | 3747 |
| Hypercholesterolaemia Glu207Gln cGAG-CAG | GAGTGCATCCACTCCAGCTGGCGCTGTGATGGTGGCCCCGA CTGCAAGGACAAATCTGACGAGGAAAACTGCGGTATGGGCG GGGCCAGGGTGGGGGCGGGGCGTCCTATCACCTGTCCCT | 3748 |
| | AGGGACAGGTGATAGGACGCCCCGCCCCCACCGCTGGCCCC GCCCATACCGCAGTTTTCCTCGTCAGATTTGTCCTTGCAGTC GGGGCCACCATCACAGCGCCAGCTGGAGTGGATGCACTC | 3749 |
| | AATCTGACGAGGAAAAC | 3750 |
| | GTTTTCCTCGTCAGATT | 3751 |
| Hypercholesterolaemia Glu207Lys cGAG-AAG | GAGTGCATCCACTCCAGCTGGCGCTGTGATGGTGGCCCCGA CTGCAAGGACPAATCTGACGAGGAAAACTGCGGTATGGGCG GGGCCAGGGTGGGGGCGGGGCGTCCTATCACCTGTCCCT | 3752 |
| | AGGGACAGGTGATAGGACGCCCCGCCCCCACCCTGGCCCC GCCCATACCGCAGTTTTCCTCGTCAGATTTGTCCTTGCAGTC GGGGCCACCATCACAGCGCCAGCTGGAGTGGATGCACTC | 3753 |
| | AATCTGACGAGGAAAAC | 3754 |
| | GTTTTCCTCGTCAGATT | 3755 |
| Hypercholesterolaemia Glu207Term cGAG-TAG | GAGTGCATCCACTCCAGCTGGCGCTGTGATGGTGGCCCCGA CTGCAAGGACAAATCTGACGAGGAAAACTGCGGTATGGGCG GGGCCAGGGTGGGGGCGGGGCGTCCTATCACCTGTCCCT | 3756 |
| | AGGGACAGGTGATAGGACGCCCCGCCCCCACCCTGGCCCC GCCCATACCGCAGTTTTCCTCGTCAGATTTGTCCTTGCAGTC GGGGCCACCATCACAGCGCCAGCTGGAGTGGATGCACTC | 3757 |
| | AATCTGACGAGGAAAAC | 3758 |
| | GTTTTCCTCGTCAGATT | 3759 |

TABLE 28-continued

LDLR Mutations and Genome-Correcting Oligos

| Clinical Phenotype & Mutation | Correcting Oligos | SEQ ID NO: |
|---|---|---|
| Hypercholesterolaemia Glu219Lys cGAA-AAA | TCTTGAGAAAATCAACACACTCTGTCCTGTTTTCCAGCTGTGG CCACCTGTCGCCCTGACGAATTCCAGTGCTCTGATGGAAACT GCATCCATGGCAGCCGGCAGTGTGACCGGGAATATG | 3760 |
| | CATATTCCCGGTCACACTGCCGGCTGCCATGGATGCAGTTTC CATCAGAGCACTGGAATTCGTCAGGGCGACAGGTGGCCACA GCTGGAAAACAGGACAGAGTGTGTTGATTTTCTCAAGA | 3761 |
| | GCCCTGACGAATTCCAG | 3762 |
| | CTGGAATTCGTCAGGGC | 3763 |
| Hypercholesterolaemia Gln221Term cCAG-TAG | GAAAATCAACACACTCTGTCCTGTTYCCAGGTGTGGCCACCT GTCGCCCTGACGAATTCCAGTGCTCTGATGGAAACTGCATCC ATGGCAGCCGGCAGTGTGACCGGGAATATGACTGCA | 3764 |
| | TGCAGTCATATTCCCGGTCACACTGCCGGCTGCCATGGATGC AGTTTCCATCAGAGCACTGGAATTCGTCAGGGCGACAGGTGG CCACAGCTGGAAAACAGGACAGAGTGTGTTGATTTTC | 3765 |
| | ACGAATTCCAGTGCTCT | 3766 |
| | AGAGCACTGGAATTCGT | 3767 |
| Hypercholesterolaemia Cys227Phe TGC-TTC | CCTGTTTTCCAGCTGTGGCCACCTGTCGCCCTGACGAATTCC AGTGCTCTGATGGAAACTGCATCCATGGCAGCCGGCAGTGT GACCGGGAATATGACTGCAAGGACATGAGCGATGAAGT | 3768 |
| | ACTTCATCGCTCATGTCCTTGCAGTCATATTCCCGGTCACACT GCCGGCTGCCATGGATGCAGTTTCCATCAGAGCACTGGAATT CGTCAGGGCGACAGGTGGCCACAGCTGGAAAACAGG | 3769 |
| | TGGAAACTGCATCCATG | 3770 |
| | CATGGATGCAGTTTCCA | 3771 |
| Hypercholesterolaemia Asp235Glu GACc-GAA | TCGCCCTGACGAATTCCAGTGCTCTGATGGAAACTGCATCCA TGGCAGCCGGCAGTGTGACCGGGAATATGACTGCAAGGACA TGAGCGATGAAGTTGGTTAATGGTGAGCGCTGG | 3772 |
| | CCAGCGCTCACCATTAACGCAGCCAACTTCATCGCTCATGTC CTTGCAGTCATATTCCCGGTCACACTGCCGGCTGCCATGGAT GCAGTTTCCATCAGAGCACTGGAATTCGTCAGGGCGA | 3773 |
| | CAGTGTGACCGGGAATA | 3774 |
| | TATTCCCGGTCACACTG | 3775 |
| Hypercholesterolaemia Asp235Gly GAC-GGC | GTCGCCCTGACGAATTCCAGTGCTCTGATGGAAACTGCATCC ATGGCAGCCGGCAGTGTGACCGGGAATATGACTGCAAGGAC ATGAGCGATGAAGTTGGCTGCGTTAATGGTGAGCGCTG | 3776 |
| | CAGCGCTCACCATTAACGCAGCCAACTTCATCGCTCATGTCC TTGCAGTCATATTCCCGGTCACACTGCCGGCTGCCATGGATG CAGTTTCCATCAGAGCACTGGAATFCGTCAGGGCGAC | 3777 |
| | GCAGTGTGACCGGGAAT | 3778 |
| | ATTCCCGGTCACACTGC | 3779 |
| Hypercholesterolaemia Glu237Lys gGAA-AAA | CCTGACGAATTCCAGTGCTCTGATGGAAACTGCATCCATGGC AGCCGGCAGTGTGACCGGGAATATGACTGCAAGGACATGAG CGATGAAGTTGGCTGCGTTAATGGTGAGCGCTGGCCAT | 3780 |
| | ATGGCCAGCGCTCACCATTAACGCAGCCAACTTCATCGCTCA TGTCCTTGCAGTCATATTCCCGGTCACACTGCCGGCTGCCAT GGATGCAGTTTCCATCAGAGCACTGGAATTCGTCAGG | 3781 |
| | GTGACCGGGAATATGAC | 3782 |
| | GTCATATTCCCGGTCAC | 3783 |
| Hypercholesterolaemia Cys240Phe | TCCAGTGCTCTGATGGAAACTGCATCCATGGCAGCCGGCAGT GTGACCGGGAATATGACTGCAAGGACATGAGCGATGAAGTTG | 3784 |

TABLE 28-continued

LDLR Mutations and Genome-Correcting Oligos

| Clinical Phenotype & Mutation | Correcting Oligos | SEQ ID NO: |
|---|---|---|
| TGC-TTC | GCTGCGTTAATGGTGAGCGCTGGCCATCTGGTTFTCC | |
| | GGAAAACCAGATGGCCAGCGCTCACCABAACGCAGCCAACT TCATCGCTCATGTCCTTGCAGTCATATTCCCGGTCACACTGC CGGCTGCCATGGATGCAGTTTCCATCAGAGCACTGGA | 3785 |
| | ATATGACTGCAAGGACA | 3786 |
| | TGTCCTTGCAGTCATAT | 3787 |
| Hypercholesterolaemia Asp245Glu GATg-GAA | AAACTGCATCCATGGCAGCCGGCAGTGTGACCGGGAATATG ACTGCAAGGACATGAGCGATGAAGTTGGCTGCGTTAATGGTG AGCGCTGGCCATCTGGTTTTCCATCCCCCATTCTCTGT | 3788 |
| | ACAGAGAATGGGGGATGGAAAACCAGATGGCCAGCGCTCAC CATTAACGGAGCCAACTTCATCGCTCATGTCCTTGCAGTCATA TTCCCGGTCACACTGCCGGCTGCCATGGATGCAGTTT | 3789 |
| | ATGAGCGATGAAGTTGG | 3790 |
| | CCAACTTCATCGCTCAT | 3791 |
| Hypercholesterolaemia Cys249Tyr TGC-TAC | ATGGCAGCCGGCAGTGTGACCGGGAATATGACTGCAAGGAC ATGAGCGATGAAGTTGGCTGCGTTAATGGTGAGCGCTGCC ATCTGGTTTTCCATCCCCATTCTCTGTGCCTTGCTGCT | 3792 |
| | AGCAGCAAGGCACAGAGAATGGGGGATGGAAAACCAGATGG CCAGCGCTCACCATTAACGCAGCCAACTTCATCGCTCATGTC CTTGCAGTCATATTCCCGGTCACACTGCCGGCTGCCAT | 3793 |
| | AGTTGGCTGCGTTAATG | 3794 |
| | CATTAACGCAGCCAACT | 3795 |
| Hypercholesterolaemia Glu256Lys cGAG-AAG | AGGCTCAGACACACCTGACCTTCCTCCTTCCTCTCTCTGGCT CTCACAGTGACACTCTGCGAGGGACCCAACAAGTTCAAGTGT CACAGCGGCGAATGCATCACCCTGGACAAAGTCTGCA | 3796 |
| | TGCAGACTTTGTCCAGGGTGATGCATTCGCCGCTGTGACACT TGAACTTGTTGGGTCCCTCGCAGAGTGTCACTGTGAGAGCCA GAGAGAGGAAGGAGGAAGGTCAGGTGTGTCTGAGCCT | 3797 |
| | CACTCTGCGAGGGACCC | 3798 |
| | GGGTGCCTCGCAGAGTG | 3799 |
| Hypercholesterolaemia Ser265Arg AGCg-AGA | CCTCTCTCTGGCTCTCACAGTGACACTCTGCGAGGGACCCAA CAAGTTCAAGTGTCACAGCGGCGAATGCATCACCCTGGACAA AGTCTGCAACATGGCTAGAGACTGCCGGGACTGGTCA | 3800 |
| | TGACCAGTCCCGGCAGTCTCTAGCCATGTTGCAGACTTTGTC CAGGGTGATGCATTCGCCGCTGTGACACTTGAACTTGTFGGG TCCCTCGCAGAGTGTCACTGTGAGAGCCAGAGAGAGG | 3801 |
| | TGTCACAGCGGCGAATG | 3802 |
| | CATTCGCCGCTGTGACA | 3803 |
| Hypercholesterolaemia Glu267Lys cGAA-AAA | TCTCTGGCTCTCACAGTGACACTCTGCGAGGGACCCAACAAG TTCAAGTGTCACAGCGGCGAATGCATCACCCTGGACAAAGTC TGCAACATGGCTAGAGACTGCCGGGACTGGTCAGATG | 3804 |
| | CATCTGACCAGTCCCGGCAGTCTCTAGCCATGTTGCAGACTT TGTCCAGGGTGATGCATTCGCCGCTGTGACACTTGAACTTGT TGGGTCCCTCGCAGAGTGTCACTGTGAGAGCCAGAGA | 3805 |
| | ACAGCGGCGAATGCATC | 3806 |
| | GATGCATTCGCCGCTGT | 3807 |
| Hypercholesterolaemia Glu267Term cGAA-TAA | TCTCTGGCTCTGACAGTGACACTCTGCGAGGGACCCAACAAG TTCAAGTGTCACAGCGGCGAATGCATCACCCTGGACAAAGTC TGCAACATGGCTAGAGACTGCCGGGACTGGTCAGATG | 3808 |

TABLE 28-continued

LDLR Mutations and Genome-Correcting Oligos

| Clinical Phenotype & Mutation | Correcting Oligos | SEQ ID NO: |
|---|---|---|
| | CATCTGACCAGTCCCGGCAGTCTCTAGCCATGTTGCAGACTT TGTCCAGGGTGATGCATTCGCCGCTGTGACACTTGAACTFGT TGGGTCCCTCGCAGAGTGTCACTGTGAGAGCCAGAGA | 3809 |
| | ACAGCGGCGAATGCATC | 3810 |
| | GATGCATTCGCCGCTGT | 3811 |
| Hypercholesterolaemia Lys273Glu cAAA-GAA | ACACTCTGCGAGGGACCCAACAAGTTCAAGTGTCACAGCGG CGAATGCATCACCCTGGACAAAGTCTGCAACATGGCTAGAGA CTGCCGGGACTGGTCAGATGAACCCATCAAAGAGTGCG | 3812 |
| | CGCACTCTTTGATGGGTTCATCTGACCAGTCCCGGCAGTCTC TAGCCATGTTGCAGACTTTGTCCAGGGTGATGCATTCGCCGC TGTGACACTTGAACTTGTTGGGTCCCTCGCAGAGTGT | 3813 |
| | CCCTGGACAAAGTCTGC | 3814 |
| | GCAGACTTTGTCCAGGG | 3815 |
| Hypercholesterolaemia Cys275Term TGCa-TGA | CGAGGGACCCAACAAGTTCAAGTGTCACAGCGGCGAATGCA TCACCCTGGACAAAGTCTGCAACATGGCTAGAGACTGCCGG GACTGGTCAGATGAACCCATCAAAGAGTGCGGTGAGTCT | 3816 |
| | AGACTCACCGCACTCTTTGATGGGTTCATCTGACCAGTCCCG GCAGTCTCTAGCCATGTTGCAGACTTFGTCCAGGGTGATGCA TTCGCCGCTGTGACACTTGAACTTGTTGGGTCCCTCG | 3817 |
| | AAAGTCTGCAACATGGC | 3818 |
| | GCCATGTTGCAGACTTT | 3819 |
| Hypercholesterolaemia Asp280Gly GAC-GGC | AGTTCAAGTGTCACAGCGGCGAATGCATCACCCTGGACAAAG TCTGCAACATGGCTAGAGACTGCCGGGACTGGTCAGATGAA CCCATCAAAGAGTGCGGTGAGTCTCGGTGCAGGCGGCT | 3820 |
| | AGCCGCCTGCACCGAGACTCACCGCACTCTTTGATGGGTTCA TCTGACCAGTCCCGGCAGTCTCTAGCCATGTTGCAGACTTTG TCCAGGGTGATGCATTCGCCGCTGTGACACTTGAACT | 3821 |
| | GGCTAGAGACTGCCGGG | 3822 |
| | CCCGGCAGTCTCTAGCC | 3823 |
| Hypercholesterolaemia Cys281Tyr TGC-TAC | TCAAGTGTCACAGCGGCGAATGCATCACCCTGGACAAAGTCT GCAACATGGCTAGAGACTGCCGGGACTGGTCAGATGAACCC ATCAAAGAGTGCGGTGAGTCTCGGTGCAGGCGGCTTGC | 3824 |
| | GCAAGCCGCCTGCACCGAGACTCACCGCACTCTTTGATGGG TTCATCTGACCAGTCCCGGCAGTCTCTAGCCATGTTGCAGAC TTTGTCCAGGGTGATGCATTCGCCGCTGTGACACTTGA | 3825 |
| | TAGAGACTGCCGGGACT | 3826 |
| | AGTCCCGGCAGTCTCTA | 3827 |
| Hypercholesterolaemia Asp283Asn gGAC-AAC | TGTCACAGCGGCGAATGCATCACCCTGGACAAAGTCTGCAAC ATGGCTAGAGACTGCCGGGACTGGTCAGATGAACCCATCAAA GAGTGCGGTGAGTCTCGGTGCAGGCGGCTTGCAGAGT | 3828 |
| | ACTCTGCAAGCCGCCTGCACCGAGACTCACCGCACTCTTTGA TGGGTTCATCTGACCAGTCCCGGCAGTCTCTAGCCATGTTGC AGACTTTGTCCAGGGTGATGCATTCGCCGCTGTGACA | 3829 |
| | ACTGCCGGGACTGGTCA | 3830 |
| | TGACCAGTCCCGGCAGT | 3831 |
| Hypercholesterolaemia Asp283Glu GACt-GAG | TCACAGCGGCGAATGCATCACCCTGGACAAAGTCTGCAACAT GGCTAGAGACTGCCGGGACTGGTCAGATGAACCCATCAAAG AGTGCGGTGAGTCTCGGTGCAGGCGGCTTGCAGAGTTT | 3832 |
| | AAACTCTGCAAGCCGCCTGCACCGAGACTCACCGCACTCTTT GATGGGTTCATCTGACCAGTCCCGGCAGTCTCTAGCCATGTT | 3833 |

TABLE 28-continued

LDLR Mutations and Genome-Correcting Oligos

| Cilnical Phenotype & Mutation | Correcting Oligos | SEQ ID NO: |
|---|---|---|
| | GCAGACTTTGTCCAGGGTGATGCATTCGCCGCTGTGA | |
| | TGCCGGGACTGGTCAGA | 3834 |
| | TCTGACCAGTCCCGGCA | 3835 |
| Hypercholesterolaemia Asp283Tyr gGAC-TAC | TGTCACAGCGGCGAATGCATCACCCTGGACAAAGTCTGCAAC ATGGCTAGAGACTGCCGGGACTGGTCAGATGAACCCATCAAA GAGTGCGGTGAGTCTCGGTGCAGGCGGCTTGCAGAGT | 3836 |
| | ACTCTGCAAGCCGCCTGCACCGAGACTCACCGCACTCTTTGA TGGGTTCATCTGACCAGTCCCGGCAGTCTCTAGCCATGTTGC AGACTTTGTCCAGGGTGATGCATTCGCCGCTGTGACA | 3837 |
| | ACTGCCGGGACTGGTCA | 3838 |
| | TGACCAGTCCCGGCAGT | 3839 |
| Hypercholesterolaemia Trp284Term TGGt-TGA | CAGCGGCGAATGCATCACCCTGGACAAAGTCTGCAACATGG CTAGAGACTGCCGGGACTGGTCAGATGAACCCATCTAAAGAGT GCGGTGAGTCTCGGTGCAGGCGGCTTGCAGAGTTTGTG | 3840 |
| | CACTAAACTCTGCAAGCCGCCTGCACCGAGACTGACCGCACT CTTTGATGGGTTCATCTGACCAGTCCCGGCAGTCTCTAGCCA TGTTGCAGACTTFGTCCAGGGTGATGCATTCGCCGCTG | 3841 |
| | CGGGACTGGTCAGATGA | 3842 |
| | TCATCTGACCAGTCCCG | 3843 |
| Hypercholesterolaemia Ser285Leu TCA-TTA | GCGGCGAATGCATCACCCTGGACAAAGTCTGCAACATGGCTA GAGACTGCCGGGACTGGTCAGATGAACCCATCAAAGAGTGC GGTGAGTCTCGGTGCAGGCGGCTTGCAGAGTTTGTGGG | 3844 |
| | CCCACAAACTCTGCAAGCCGCCTGCACCGAGACTCACCGCA CTCTTTGATGGGTTCATCTGACCAGTCCCGGCAGTCTCTAGC CATGTTGCAGACTTTGTCCAGGGTGATGCATTCGCCGC | 3845 |
| | GGACTGGTCAGATGAAC | 3846 |
| | GTTCATCTGACCAGTCC | 3847 |
| Hypercholesterolaemia Lys290Arg AAA-AGA | CCCTGGACTAAAGTCTGCAACATGGCTAGAGACTGCCGGGAC TGGTCAGATGAACCCATCAAAGAGTGCGGTGAGTCTCGGTG CAGGCGGCTTGCAGAGTTTGTGGGGAGCCAGGAAAGGGA | 3848 |
| | TCCCTTTCGTGGCTCCCCACAAACTCTGCAAGCCGCCTGCAC CGAGACTCACCGCACTCTTTGATGGGTTCATCTGACCAGTCC CGGCAGTCTCTAGCCATGTTGCAGACTTTGTCCAGGG | 3849 |
| | ACCCATCAAAGAGTGCG | 3850 |
| | CGCACTCTTTGATGGGT | 3851 |
| Hypercholesterolaemia Cys297Phe TGC-TTC | GGGTAGGGGCCCGAGAGTGACCAGTCTGCATCCCCTGGCCC TGCGCAGGGACCAACGAATGCTTGGACAACAACGGCGGCTG TTCCCACGTCTGCAATGACCTTAAGATCGGCTACGAGTG | 3852 |
| | CACTCGTAGCCGATCTTAAGGTCATTGCAGACGTGGGAACAG CCGCCGTTGTTGTCCAAGCATTCGTTGGTCCCTGCGCAGGG CCAGGGGATGCAGACTGGTCACTCTCGGGCCCCTACCC | 3853 |
| | CAACGAATGCTTGGACA | 3854 |
| | TGTCCAAGCATTCGTTG | 3855 |
| Hypercholesterolaemia Cys297Tyr TGC-TAC | GGGTAGGGGCCCGAGAGTGACCAGTCTGCATCCCCTGGCCC TGCGCAGGGACCAACGAATGCTTGGACAACAACGGCGGCTG TTCCCACGTCTGCAATGACCTTAAGATCGGCTACGAGTG | 3856 |
| | CACTCGTAGCCGATCTTAAGGTCATTGCAGACGTGGGAACAG CCGCCGTTGTTGTCCAAGCATTCGTTGGTCCCTGCGCAGGG CCAGGGGATGCAGACTGGTCACTCTCGGGCCCCTACCC | 3857 |

TABLE 28-continued

LDLR Mutations and Genome-Correcting Oligos

| Cilnical Phenotype & Mutation | Correcting Oligos | SEQ ID NO: |
|---|---|---|
| | CAACGAATGCTTGGACA | 3858 |
| | TGTCCAAGCATTCGTTG | 3859 |
| Hypercholesterolaemia His306Tyr cCAC-TAC | TGCATCCCCTGGCCCTGCGCAGGGACCAACGAATGCTTGGA CAACAACGGCGGCTGTTCCCACGTCTGCAATGACCTTAAGAT CGGCTACGAGTGCCTGTGCCCCGACGGCTTCCAGCTGG | 3860 |
| | CCAGCTGGAAGCCGTCGGGGCACAGGCACTCGTAGCCGATC TTAAGGTCATTGCAGACGTGGGAACAGCCGCCGTTGTTGTCC AAGCATTCGTTGGTCCCTGCGCAGGGCCAGGGGATGCA | 3861 |
| | GCTGTTCCCACGTCTGC | 3862 |
| | GCAGACGTGGGAACAGC | 3863 |
| Hypercholesterolaemia Cys308Gly cTGC-GGC | CCCTGGCCCTGCGCAGGGACCAACGAATGCTTGGACAACAA CGGCGGCTGTTCCCACGTCTGCAATGACCTTAAGATCGGCTA CGAGTGCCTGTGCCCCGACGGCTTCCAGCTGGTGGCCC | 3864 |
| | GGGCCACCAGCTGGAAGCCGTCGGGGCACAGGCACTCGTA GCCGATCTTAAGGTCATTGCAGACGTGGGAACAGCCGCCGT TGTTGTCCAAGCATTCGTTGGTCCCTGCGCAGGGCCAGGG | 3865 |
| | CCCACGTCTGCAATGAC | 3866 |
| | GTCATTGCAGACGTGGG | 3867 |
| Hypercholesterolaemia Cys308Tyr TGC-TAC | CCTGGCCCTGCGCAGGGACCAACGAATGCTTGGACAACAAC GGCGGCTGTTCCCACGTCTGCAATGACCTTAAGATCGGCTAC GAGTGCCTGTGCCCCGACGGCTTCCAGCTGGTGGCCCA | 3868 |
| | TGGGCCACCAGCTGGAAGCCGTCGGGGCACAGGCACTCGTA GCCGATCTTAAGGTCATTGCAGACGTGGGAACAGCCGCCGTT GTTGTCCAAGCATTCGTTGGTCCCTGCGCAGGGCCAGG | 3869 |
| | CCACGTCTGCAATGACC | 3870 |
| | GGTCATTGCAGACGTGG | 3871 |
| Hypercholesterolaemia Gly314Ser cGGC-AGC | ACCAACGAATGCTTGGACAACAACGGCGGCTGTTCGCACGTC TGCAATGACCTTAAGATCGGCTACGAGTGGCTGTGCCCCGAC GGCTTCCAGCTGGTGGCCCAGCGAAGATGCGAAGGTG | 3872 |
| | CACCTTCGCATCTTCGCTGGGCCACCAGCTGGAAGCCGTCG GGGCACAGGCACTCGTAGCCGATCTTAAGGTCATTGCAGAC GTGGGAACAGCCGCCGTTGTTGTCCAAGCATTCGTTGGT | 3873 |
| | TTAAGATCGGCTACGAG | 3874 |
| | CTCGTAGCCGATCTTAA | 3875 |
| Hypercholesterolaemia Gly314Val GGC-GTC | CCAACGAATGCTTGGACAACAACGGCGGCTGTTCCCACGTCT GCAATGACCTTAAGATCGGCTACGAGTGCCTGTGCCCCGAC GGCTTCCAGCTGGTGGCCCAGCGAAGATGCGAAGGTGA | 3876 |
| | TCACCTTCGCATCTTCGCTGGGCCACCAGCTGGAAGCCGTC GGGGCACAGGCACTCGTAGCCGATCTTAAGGTCATTGCAGA CGTGGGAACAGCCGCCGTTGTTGTCCAAGCATTCGTTGG | 3877 |
| | TAAGATCGGCTACGAGT | 3878 |
| | ACTCGTAGCCGATCTTA | 3879 |
| Hyperchoesterolaemia Tyr315Term TACg-TAA | CGAATGCTTGGACAACAACGGCGGCTGTTCCCACGTCTGCAA TGACCTTAAGATCGGCTACGAGTGCCTGTGCCCCGACGGCTT CCAGCTGGTGGCCCAGCGAAGATGCGAAGGTGATTTC | 3880 |
| | GAAATCACCTTCGCATCTTCGCTGGGCCACCAGCTGGAAGCC GTCGGGGCACAGGCACTCGTAGCCGATCTTAAGGTCATTGCA GACGTGGGAACAGCCGCCGTTGTTGTCCAAGCATTCG | 3881 |
| | ATCGGCTACGAGTGCCT | 3882 |
| | AGGCACTCGTAGCCGAT | 3883 |

TABLE 28-continued

LDLR Mutations and Genome-Correcting Oligos

| Cilnical Phenotype & Mutation | Correcting Oligos | SEQ ID NO: |
|---|---|---|
| Hypercholesterolaemia Cys317Gly gTGC-GGC | TGCTTGGACAACTAACGGCGGCTGTTCCCACGTCTGCAATGAC CTTAAGATCGGCTACGAGTGCCTGTGCCCCGACGGCTTCCA GCTGGTGGCCCAGCGAAGATGCGAAGGTGATTTCCGGG | 3884 |
| | CCCGGAAAATCACCTTCGCATCTTCGCTGGGCCACCAGCTGG AAGCCGTCGGGGCACAGGCACTCGTAGCCGATCTTAAGGTC ATTGCAGACGTGGGAACAGCCGCCGTTGTTGTCCAAGCA | 3885 |
| | GCTACGAGTGCCTGTGC | 3886 |
| | GCACAGGCACTCGTAGC | 3887 |
| Hypercholesterolaemia Cys317Ser gTGC-AGC | TGCTTGGACAACAACGGCGGCTGTTCCCACGTCTGCAATGAC CTTAAGATCGGCTACGAGTGCCTGTGCCCCGACGGCTTCCA GCTGGTGGCCCAGCGAAGATGCGAAGGTGATTTCCGGG | 3888 |
| | CCCGGAAATCACCTFCGCATCTTCGCTGGGCCACCAGCTGG AAGCCGTCGGGGCACAGGCACTCGTAGCCGATCTTAAGGTC ATTGCAGACGTGGGAACAGCCGCCGTTGTTGTCCAAGCA | 3889 |
| | GCTACGAGTGCCTGTGC | 3890 |
| | GCACAGGCACTCGTAGC | 3891 |
| Hypercholesterlaemia Pro320Arg CCC-CGC | ACAACGGCGGCTGTTCCCACGTCTGCAATGACCTTAAGATCG GCTACGAGTGCCTGTGCCCCGACGGCTTCCAGCTGGTGGCC CAGCGAAGATGCGAAGGTGATTTCCGGGTGGGACTGAG | 3892 |
| | CTCAGTCCCACCCGGAAATCACCTTCGCATCTTCGCTGGGCC ACCAGCTGGAAGCCGTCGGGGCACAGGCACTCGTAGCCGAT CTTAAGGTCATTGCAGACGTGGGAACAGCCGCCGTTGT | 3893 |
| | CCTGTGCCCCGACGGCT | 3894 |
| | AGCCGTCGGGGCACAGG | 3895 |
| Hypercholesterolaemia Asp321Asn cGAC-AAC | AACGGCGGCTGTTCCCACGTCTGCAATGACCTTAAGATCGGC TACGAGTGCCTGTGCCCCGACGGCTTCCAGCTGGTGGCCCA GCGAAGATGCGAAGGTGATTTCCGGGTGGGACTGAGCC | 3896 |
| | GGCTCAGTCCCACCCGGAAATCACCTTCGCATCTTCGCTGGG CCACCAGCTGGAAGCCGTCGGGGCACAGGCACTCGTAGCCG ATCTTAAGGTCATTGCAGACGTGGGAACAGCCGCCGTT | 3897 |
| | TGTGCCCCGACGGCTTC | 3898 |
| | GAAGCCGTCGGGGCACA | 3899 |
| Hypercholesterolaemia Asp321Glu GACg-GAG | CGGCGGCTGTTCCCACGTCTGCAATGACCTTAAGATCGGCTA CGAGTGCCTGTGCCCCGACGGCTTCCAGCTGGTGGCCCAGC GAAGATGCGAAGGTGATTTCCGGGTGGGACTGAGCCCT | 3900 |
| | AGGGCTCAGTCCCACCCGGAAATCACCTTCGCATCTTCGCTG GGCCACCAGCTGGAAGCCGTCGGGGCACAGGCACTCGTAG CCGATCTTAAGGTCATTGCAGACGTGGGAACAGCCGCCG | 3901 |
| | TGCCCCGACGGCTTCCA | 3902 |
| | TGGAAGCCGTCGGGGCA | 3903 |
| Hypercholesterolaemia Gly322Ser cGGC-AGC | GGCGGCTGTTCCCACGTCTGCAATGACCTTAAGATCGGCTAC GAGTGCCTGTGCCCCGACGGCTTCCAGCTGGTGGCCCAGCG AAGATGCGAAGGTGATTTCCGGGTGGGACTGAGCCCTG | 3904 |
| | CAGGGCTCAGTCCCACCCGGAAATCACCTTCGCATCTTCGCT GGGCCACCAGCTGGAAGCCCGTCGGGGCACAGGCACTCGTA GCCGATCTTAAGGTCATTGCAGACGTGGGAACAGCCGGC | 3905 |
| | GCCCCGACGGCTTCCAG | 3906 |
| | CTGGAAGCCCGTCGGGGC | 3907 |
| Hypercholesterolaemia Gln324Term | TGTTCCCACGTCTGCAATGACCTTAAGATCGGCTACGAGTGC CTGTGCCCCGACGGCTTCCAGCTGGTGGCCCAGCGAAGATG | 3908 |

TABLE 28-continued

LDLR Mutations and Genome-Correcting Oligos

| Cilnical Phenotype & Mutation | Correcting Oligos | SEQ ID NO: |
|---|---|---|
| cCAG-TAG | CGAAGGTGATTTCCGGGTGGGACTGAGCCCTGGGCCCC | |
| | GGGGCCCAGGGCTCAGTCCCACCCGGAAATCACCTTCGCAT CTTCGCTGGGCCACCAGCTGGAAGCCGTCGGGGCACAGGCA CTCGTAGCCGATCTTAAGGTCATTGCAGACGTGGGAACA | 3909 |
| | ACGGCTTCCAGCTGGTG | 3910 |
| | CACCAGCTGGAAGCCGT | 3911 |
| Hypercholesterolaemia Arg329Pro CGA-CCA | ATGACCTTAAGATCGGCTACGAGTGCCTGTGCCCCGACGGC TTCCAGCTGGTGGCCCAGCGAAGATGCGAAGGTGATTTCCG GGTGGGACTGAGCCCTGGGCCCGCTCTGCGCTTCCTGAC | 3912 |
| | GTCAGGAAGCGCAGAGGGGGCCCAGGGCTCAGTCCCACCC GGAAATCACCTTCGCATCTTCGCTGGGCCACCAGCTGGAAG CCGTCGGGGCACAGGCACTCGTAGCCGATCTTAAGGTCAT | 3913 |
| | GGCCCAGCGAAGATGCG | 3914 |
| | CGCATCTTCGCTGGGCC | 3915 |
| Hypercholesterolaemia Arg329Term gCGA-TGA | AATGACCTTAAGATCGGCTACGAGTGCCTGTGCCCCGACGG CTTCCAGCTGGTGGCCCAGCCGAAGATGCGAAGGTGATTTCC GGGTGGGACTGAGCCCTGGGCCCCCTCTGCGCTTCCTGA | 3916 |
| | TCAGGAAGCGCAGAGGGGGCCCAGGGCTCAGTCCCACCCG GAAATCACCTTCGCATCTTCGCTGGGCCACCAGCTGGAAGCC GTCGGGGCACAGGCACTCGTAGCCGATCTTAAGGTCATT | 3917 |
| | TGGCCCAGCGAAGATGC | 3918 |
| | GCATCTTCGCTGGGCCA | 3919 |
| Hypercholesterolaemia Glu336Lys tGAG-AAG | TCTAGCCATTGGGGAAGAGCCTCCCCACCAAGCCTCTTTCTC TCTCTTCCAGATATCGATGAGTGTCAGGATCCCGACACCTGC AGCCAGCTCTGCGTGAACCTGGAGGGTGGCTACAAGT | 3920 |
| | ACTTGTAGCCACCCTCCAGGTTCACGCAGAGCTGGCTGCAG GTGTCGGGATCCTGACACTCATCGATATCTGGAAGAGAGAGA AAGAGGCTTGGTGGGGAGGCTCTTCCCCAATGGCTAGA | 3921 |
| | ATATCGATGAGTGTCAG | 3922 |
| | CTGACACTCATCGATAT | 3923 |
| Hypercholesterolaemia Gln338Term tCAG-TAG | CATTGGGGAAGAGCCTCCCCACCAAGCCTCTTTCTCTCTCTT CCAGATATCGATGAGTGTCAGGATCCCGACACCTGCAGCCAG CTCTGCGTGAACCTGGAGGGTGGCTACAAGTGCCAGT | 3924 |
| | ACTGGCACTTGTAGCCACCCTCCAGGTTCACGCAGAGCTGG CTGCAGGTGTCGGGATCCTGACACTCATCGATATCTGGAAGA GAGAGAAAGAGGCTTGGTGGGGAGGCTCTTCCCCAATG | 3925 |
| | ATGAGTGTCAGGATCCC | 3926 |
| | GGGATCCTGACACTCAT | 3927 |
| Hypercholesterolaemia Cys343Arg cTGC-CGC | TCCCCACCAAGCCTCTTFCTCTCTCTTCCAGATATCGATGAGT GTCAGGATCCCGACACCTGCAGCCAGCTCTGCGTGAACCTG GAGGGTGGCTACAAGTGCCAGTGTGAGGAAGGCTTCC | 3928 |
| | GGAAGCCTTCCTCACACTGGCACTTGTAGCCACCCTCCAGGT TCACGCAGAGCTGGCTGCAGGTGTCGGGATCCTGACACTCA TCGATATCTGGAAGAGAGAGAAAGAGGCTTGGTGGGGA | 3929 |
| | CCGACACCTGCAGCCAG | 3930 |
| | CTGGCTGCAGGTGTCGG | 3931 |
| Hypercholesterolaemia Gln345Arg CAG-CGG | CAAGCCTCTTTCTCTCTCTTCCAGATATCGATGAGTGTCAGGA TCCCGACACCTGCAGCCAGCTCTGCGTGAACCTGGAGGGTG GCTACAAGTGCCAGTGTGAGGAAGGCTTCCAGCTGGA | 3932 |

TABLE 28-continued

LDLR Mutations and Genome-Correcting Oligos

| Clinical Phenotype & Mutation | Correcting Oligos | SEQ ID NO: |
|---|---|---|
| | TCCAGCTGGAAGCCTTCCTCAGACTGGCACTTGTAGCCACCC TCCAGGTTCACGCAGAGCTGGCTGCAGGTGTCGGGATCCTG ACACTCATCGATATCTGGAAGAGAGAGAAAGAGGCTTG | 3933 |
| | CTGCAGCCAGCTCTGCG | 3934 |
| | CGCAGAGCTGGCTGCAG | 3935 |
| Hypercholesterolaemia Cys347Tyr TGC-TAC | TCTTTCTCTCTCTTCCAGATATCGATGAGTGTCAGGATCCCGA CACCTGCAGCCAGCTCTGCGTGAACCTGGAGGGTGGCTACA AGTGCCAGTGTGAGGAAGGCTTCCAGCTGGACCCCCA | 3936 |
| | TGGGGGTCCAGCTGGAAGCCTTCCTCACACTGGCACTTGTA GCCACCCTCCAGGTTCACGCAGAGCTGGCTGCAGGTGTCGG GATCCTGACAGTCATCGATATCTGGAAGAGAGAGAAAGA | 3937 |
| | CCAGCTCTGCGTGAACC | 3938 |
| | GGTTCACGCAGAGCTGG | 3939 |
| Hypercholesterolaemia Cys347Arg cTGC-CGC | CTCTTTCTCTCTCTTCCAGATATCGATGAGTGTCAGGATCCCG ACACCTGCAGCCAGCTCTGCGTGAACCTGGAGGGTGGCTAC AAGTGCCAGTGTGAGGAAGGCTTCCAGCTGGACCCCC | 3940 |
| | GGGGGTCCAGCTGGAAGCCTTCCTCACACTGGCACTTGTAG CCACCCTCCAGGTTCACGCAGAGCTGGCTGCAGGTGTCGGG ATCCTGACACTCATCGATATCTGGXAGAGAGAGAAAGAG | 3941 |
| | GCCAGCTCTGCGTGAAC | 3942 |
| | GTTCACGCAGAGCTGGC | 3943 |
| Hypercholesterolaemia Gly352Asp GGT-GAT | CAGATATCGATGAGTGTCAGGATCCCGACACCTGCAGCCAGC TCTGCGTGAACCTGGAGGGTGGCTACAAGTGCCAGTGTGAG GAAGGCTTCCAGCTGGACCCCCACACGAAGGCCTGCAA | 3944 |
| | TTGCAGGCCTTCGTGTGGGGGTCCAGCTGGAAGCCTTCCTC ACACTGGCACTTGTAGCCACCCTCCAGGTTCACGCAGAGCTG GCTGCAGGTGTCGGGATCCTGACACTCATCGATATCTG | 3945 |
| | CCTGGAGGGTGGCTACA | 3946 |
| | TGTAGCCACCCTCCAGG | 3947 |
| Hypercholesterolaemia Tyr354Cys TAC-TGC | TCGATGAGTGTCAGGATCCCGACACCTGCAGCCAGCTCTGC GTGAACCTGGAGGGTGGCTACAAGTGCCAGTGTGAGGAAGG CTTCCAGCTGGACCCCCACACGAAGGCCTGCAAGGCTGT | 3948 |
| | ACAGCCTTGCAGGCCTTCGTGTGGGGTCCAGCTGGAAGCC TTCCTCACACTGGCACTTGTAGCCACCCTCCAGGTTCACGCA GAGCTGGCTGCAGGTGTCGGGATCCTGACACTCATCGA | 3949 |
| | GGGTGGCTACAAGTGCC | 3950 |
| | GGCACTTGTAGCCACCC | 3951 |
| Hypercholesterolaemia Cys358Arg gTGT-CGT | CAGGATCCCGACACCTGCAGCCAGGTCTGCGTGAACCTGGA GGGTGGCTACAAGTGCCAGTGTGAGGAAGGCTTCCAGCTGG ACCCCCACACGAAGGCCTGCAAGGCTGTGGGTGAGCACG | 3952 |
| | CGTGCTCACCCACAGCCTTGCAGGCCTTCGTGTGGGGGTCC AGCTGGAAGCCTTCCTCACACTGGCACTTGTAGCCACCCTCC AGGTTCACGCAGAGCTGGCTGCAGGTGTCGGGATCCTG | 3953 |
| | AGTGCCAGTGTGAGGAA | 3954 |
| | TTCCTCACACTGGCACT | 3955 |
| Hypercholesterolaemia Gln363Term cCAG-TAG | TGCAGCCAGCTCTGCGTGAACCTGGAGGGTGGCTACAAGTG CCAGTGTGAGGAAGGCTTCCAGCTGGACCCCCACACGAAGG CCTGCAAGGCTGTGGGTGAGCACGGGAAGGCGGCGGGTG | 3956 |
| | CACCCGCCGCCTTCCCGTGCTCACCCACAGCCTTGCAGGCC TTCGTGTGGCGGTCCAGCTGGAAGCCTTCCTCACACTGGCA | 3957 |

TABLE 28-continued

LDLR Mutations and Genome-Correcting Oligos

| Cilnical Phenotype & Mutation | Correcting Oligos | SEQ ID NO: |
|---|---|---|
| | CTTGTAGCCACCCTCCAGGTTCACGCAGAGCTGGCTGCA | |
| | AAGGCTTCCAGCTGGAC | 3958 |
| | GTCCAGCTGGAAGCCTT | 3959 |

EXAMPLE 22

UDP-glucuronosyltransferase—UGT1

Mutations in the human UGT1 gene result in a range of disease syndromes, ranging from relatively common diseases such as Gilbert's syndrome, which effects up to 7% of the population, to rare disorders such as Crigler-Najjar syndrome. Symptoms of these diseases are the result of diminished bilirubin conjugation and typically present with jaundice or, when mild, as an incidental finding during routing laboratory analysis. Severe cases of Crigler-Najar syndrome are caused by an absence of UGT1 activity and the majority of these patents die in the neonatal period. The only known treatment is liver transplant. The attached table discloses the correcting oligonucleotide base sequences for the UGT1 oligonucleotides of the invention.

TABLE 29

UGT1 Mutations and Genome-Correcting Oligos

| Clinical Phenotype & Mutation | Correcting Oligos | SEQ ID NO: |
|---|---|---|
| Crigler-Najjar syndrome 2 Leu15Arg CTG-CGG | GCAGGAGCAAAGGCGCCATGGCTGTGGAGTCCCAGGGCGG ACGCCCACTTGTCCTGGGCCTGCTGCTGTGTGTGCTGGGCC CAGTGGTGTCCCATGCTGGGAAGATACTGTTGATCCCAGT | 3960 |
| | ACTGGGATCAACAGTATCTTCCCAGCATGGGACACCACTGGGCGTCC CCCAGCACACACAGCAGCAGGCCCAGGACAAGTGGGCGTCC GCCCTGGGACTCCACAGCCATGGCGCCTTTGCTCCTGC | 3961 |
| | CCTGGGCCTGCTGCTGT | 3962 |
| | ACAGCAGCAGGCCCAGG | 33963 |
| Crigler-Najjar syndrome 1 Gln49Term CAG-TAG | GGGAAGATACTGTTGATCCCAGTGGATGGCAGCCACTGGCT GAGCATGCTTGGGGCCATCCAGCAGCTGCAGCAGAGGGGAC ATGAAATAGTTGTCCTAGCACCTGACGCCTCGTTGTACA | 3964 |
| | TGTACAACGAGGCGTCAGGTGCTAGGACAACTATTTCATGTC CCCTCTGCTGCAGCTGCTGGATGGCCCCAAGCATGCTCAGC CAGTGGCTGCCATCCACTGGGATCAACAGTATGTTCCC | 3965 |
| | GGGCCATCCAGCAGCTG | 3966 |
| | CAGCTGCTGGATGGCCC | 3967 |
| Crigler-Najjar syndrome 1 Gly71Arg GGA-AGA | CAGCAGAGGGGACATGAAATAGTTGTCCTAGCACCTGACGCC TCGTTGTACATCAGAGACGGAGCATTTTACACCTTGAAGACGT ACCCTGTGCCATTCCAAAGGGAGGATGTGAAAGAGT | 3968 |
| | ACTCTTTCACATCCTCCCTTTGGAATGGCACAGGGTACGTCTT CAAGGTGTAAAATGCTCCGTCTCTGATGTACAACGAGGCGTC AGGTGCTAGGACAACTATTTCATGTCCCCTCTGCTG | 3969 |
| | TCAGAGACGGAGCATTT | 3970 |
| | AAATGCTCCGTCTCTGA | 3971 |
| Gilbert syndrome Pro229Gln CCG-CAG | GGGTGAAGAACATGCTCATTGCCVTTTCACAGAACTTTCTGTG CGACGTGGTTTATTCCCCGTATGCAACCCTTGCCTCAGAATT CCTTCAGAGAGAGGTGACTGTCCAGGACCTATTGAG | 3972 |
| | CTCAATAGGTCCTGGACAGTCACCTCTCTCTGAAGGAATTCT GAGGCAAGGGTTGCATACGGGAATAAACCACGTCGCACAG AAGTTCTGTGAAAAGGCAATGAGCATGTTCTTCACCC | 3973 |

TABLE 29-continued

UGT1 Mutations and Genome-Correcting Oligos

| Clinical Phenotype & Mutation | Correcting Oligos | SEQ ID NO: |
|---|---|---|
| | TTATTCCCCGTATGCAA | 3974 |
| | TTGCATACGGGGAATAA | 3975 |
| Crigler-Najjar syndrome 1 Cys280Term TGC-TGA | TGTGAAGGATTACCCTAGGCCCATCATGCCCAATATGGTTTTT GTTGGTGGTAATCAACTGCCTTCACCAAAATCCACTATCCCAG GTGTGTATTGGAGTGGGACTTTTACATGCGTATATT | 3976 |
| | AATATACGCATGTAAAAGTCCCACTCCAATACACACCTGGGAT AGTGGATTTTGGTGAAGGCAGTTGATTCCACCAACAAAAAC ATATTGGGCATGATGGGCCTAGGGTAATCCTTCACA | 3977 |
| | ATCAAACTGCCTTCACCA | 3978 |
| | TGGTGAAGGCAGTTGAT | 3979 |
| Crigler-Najjar syndrome 1 Ala292Val GCC-GTC | ATCAAAGAATATGAGAAAAAATTAACTGAAAATTTTTCTTCTGG CTCTAGGAATTTGAAGCCTACATTAATGCTTCTGGAGAACATG GAATTGTGGTTTTCTCTTTGGGATCAATGGTCTC | 3980 |
| | GAGACCATTGATCCCAAAGAGAAAACCACAATTCCATGTTCTC CAGAAGCATTAATGTAGGCTTCAAATTCCTAGAGCCAGAAGAA AAATTTTCAGTTAATTTTTTCTCATATTCTTTGAT | 3981 |
| | ATTTGAAGCCTACATTA | 3982 |
| | taatgtagGCTTCAAAT | 3983 |
| Crigler-Najjar syndrome 1 Gly308Glu GGA-GAA | AGGAATTTGAAGCCTACATTAATGCTTCTGGAGAACATGGAAT TGTGGTTTTCTCTTTGGGATCAATGGTCTCAGAAATTCCAGAG AAGAAAGCTATGGCAATTGCTGATGCTTTGGGCAA | 3984 |
| | TTGCCCAAAGCATCAGCAATTGCCATAGCTTTCTTCTCTGGAA TTTCTGAGACCATTGATCCCAAAGAGAAAACCACAATTCCATG TTCTCCAGAAGCATTAATGTAGGCTTCAAATTCCT | 3985 |
| | CTCTTTGGGATCAATGG | 3986 |
| | CCATTGATCCCAAAGAG | 3987 |
| Crigler-Najjar syndrome 1 Gln331Term CAG-TAG | GTCTCAGAAATTCCAGAGAAGAAAGCTATGGCAATTGCTGAT GCTTTGGGCAAAATCCCTCAGACAGTAAGAAGATTCTATACCA TGGCCTCATATCTATTTTCACAGGAGCGCTAATCCC | 3988 |
| | GGGATTAGCGCTCCTGTGAAAATAGATATGAGGCCATGGTAT AGAATCTTCTTACTGTCTGAGGGATTTTGCCCAAAGCATCAGC AATTGCCATAGCTTTCTTCTCTGGAATTTCTGAGAC | 3989 |
| | AAATCCCTCAGACAGTA | 3990 |
| | TACTGTCTGAGGGATTT | 3991 |
| Crigler-Najjar syndrome 1 Trp335Term TGG-TGA | TCTAATCATATTATGTTCTTTCTTTACGTTCTGCTCTTTTTGCC CCTCCCAGGTCCTGTGGCGGTACACTGGAACCCGACCATCG AATCTTGCGAACAACACGATACTTGTTAAGTGGCTA | 3992 |
| | TAGCCACTTAACAAGTATCGTGTTGTTCGCAAGATTCGATGGT CGGGTTCCAGTGTACCGCCACAGGACCTGGGAGGGGCAAAA AGAGCAGAACGTAAAGAAAGAACATAATATGATTAGA | 3993 |
| | GTCCTGTGGCGGTACAC | 3994 |
| | GTGTACCGCCACAGGAC | 3995 |
| Crigler-Najjar syndrome 1 Gln357Arg CAA-CGA | ACACTGGAACCCGACCATCGAATCTTGCGAACAACACGATAC TTGTTAAGTGGCTACCCCAAAACGATCTGCTTGGTATGTTGG GCGGATTGGATGTATAGGTCAAACCAGGGTCAAATTA | 3996 |
| | TAATTTGACCCTGGTTTGACCTATACATCCAATCCGCCCAACA TACCAAGCAGATCGTTTTGGGGTAGCCACTTAACAAGTATCGT GTTGTTCGCAAGATTCGATGGTCGGGTTCCAGTGT | 3997 |
| | GCTACCCCAAAACGATC | 3998 |
| | GATCGTTTTGGGGTAGC | 3999 |

TABLE 29-continued

UGT1 Mutations and Genome-Correcting Oligos

| Clinical Phenotype & Mutation | Correcting Oligos | SEQ ID NO: |
|---|---|---|
| Crigler-Najjar syndrome 1 Gln357Term CAA-TAA | TACACTGGAACCCGACCATCGAATCTTGCGAACAACACGATA CTTGTTAAGTGGCTACCCCAAAACGATCTGCTTGGTATGTTG GGCGGATTGGATGTATAGGTCAAACCAGGGTCAAATT | 4000 |
| | AATTTGACCCTGGTTTGACCTATACATCCAATCCGCCCAACAT ACCAAGCAGATCGTTTTGGGGTAGCCACTTAACAAGTATCGT GTTGTTCGCAAGATTCGATGGTCGGGTTCCAGTGTA | 4001 |
| | GGCTACCCCAAAACGAT | 4002 |
| | ATCGTTTTGGGGTAGCC | 4003 |
| Gilbert syndrome Arg367Gly CGT-GGT | AACTCAGAGATGTAACTGCTGACATCCTCCCTATTTTGCATCT CAGGTCACCCGATGACCCGTGCCTTTATCACCCATGCTGGTT CCCATGGTGTTTATGAAAGCATATGCAATGGCGTTC | 4004 |
| | GAACGCCATTGCATATGCTTTCATAAACACCATGGGAACCAG CATGGGTGATAAAGGCACGGGTCATCGGGTGACCTGAGATG CAAAATAGGGAGGATGTCAGCAGTTACATCTCTGAGTT | 4005 |
| | CGATGACCCGTGCCTTT | 4006 |
| | AAAGGCACGGGTCATCG | 4007 |
| Crigler-Najjar syndrome 1 Ala368Thr GCC-ACC | TCAGAGATGTAACTGCTGACATCCTCCCTATTTTGCATCTCAG GTCACCCGATGACCCGTGCCTTTATCACCCATGCTGGTTCCC ATGGTGTTTATGAAAGCATATGCAATGGCGTTCCCA | 4008 |
| | TGGGAACGCCATTGCATATGCTTTCATAAACACCATGGGAAC CAGCATGGGTGATAAAGGCACGGGTCATCGGGTGACCTGAG ATGCAAAATAGGGAGGATGTCAGCAGTTACATCTCTGA | 4009 |
| | TGACCCGTGCCTTTATC | 4010 |
| | GATAAAGGCACGGGTCA | 4011 |
| Crigler-Najjar syndrome 1 Ser375Phe TCC-TTC | CCTCCCTATTTTTGCATCTCAGGTCACCCGATGACCCGTGCCT TTATCACCCATGCTGGTTCCCATGGTGTTTATGAAAGCATATG CAATGGCGTTCCCATGGTGATGATGCCCTTGTTTGG | 4012 |
| | CCAAACAAGGGCATCATCACCATGGGAACGCCATTGCATATG CTTTCATAAACACCATGGGAACCAGCATGGGTGATAAAGGCA CGGGTCATCGGGTGACCTGAGATGCAAAATAGGGAGG | 4013 |
| | TGCTGGTTCCCATGGTG | 4014 |
| | CACCATGGGAACCAGCA | 4015 |
| Crigler-Najjar syndrome 1 Ser381Arg AGC-AGG | AGGTCACCCGATGACCCGTGCCTTTATCACCCATGCTGGTTC CCATGGTGTTTATGAAAGCATATGCAATGGCGTTCCCATGGT GATGATGCCCTTGTTTGGTGATCAGATGGACAATGCA | 4016 |
| | TGCATTGTCCATCTGATCACCAAACAAGGGCATCATCACCAT GGGAACGCCATTGCATATGCTTTCATAAACACCATGGGAACC AGCATGGGTGATAAAGGCACGGGTCATCGGGTGACCT | 4017 |
| | TATGAAAGCATATGCAA | 4018 |
| | TTGCATATGCTTTCATA | 4019 |
| Crigler-Najjar syndrome 1 Ala401Pro GCA-CCA | AGCATATGCAATGGCGTTCCCATGGTGATGATGCCCTTGTTT GGTGATCAGATGGACAATGCAAAGCGCATGGAGACTAAGGG AGCTGGAGTGACCCTGAATGTTCTGGAAATGACTTCTG | 4020 |
| | CAGAAGTCATTTCCAGAACATTCAGGGTCACTCCAGCTCCCT TAGTCTCCATGCGCTTTGCATTGTCCATCTGATCACCAAACAA GGGCATCATCACCATGGGAACGCCATTGCATATGCT | 4021 |
| | TGGACAATGCAAAGCGC | 4022 |
| | GCGCTTTGCATTGTCCA | 4023 |
| Crigler-Najjar | GGAGCTGGAGTGACCCTGAATGTTCTGGAAATGACTTCTGAA | 4024 |

TABLE 29-continued

UGT1 Mutations and Genome-Correcting Oligos

| Clinical Phenotype & Mutation | Correcting Oligos | SEQ ID NO: |
|---|---|---|
| syndrome 1 Lys428Glu AAA-GAA | GATTTAGAAAATGCTCTAAAAGCAGTCATCAATGACAAAAGGT AAGAAAGAAGATACAGAAGAATACTTTGGTCATGGC | |
| | GCCATGACCAAAGTATTCTTCTGTATCTTCTTCTTTACCTTTTG TCATTGATGACTGCTTTTAGAGCATTTTCTAAATGTTCAGAAGT CATTTCCAGAACATTCAGGGTCACTCCAGCTCC | 4025 |
| | ATGCTCTAAAAGCAGTC | 4026 |
| | GACTGCTTTTAGAGCAT | 4027 |
| Crigler-Najjar syndrome 1 Tyr486Asp TAC-GAC | ATGAGGCACAAGGGCGCGCCACACCTGCGCCCCGCAGCCC ACGACCTCACCTGGTACCAGTACCATTCCTTGGACGTGATTG GTTTCCTCTTGGCCGTCGTGCTGACAGTGGCCTTCATCA | 4028 |
| | TGATGAAGGCCACTGTCAGCACGACGGCCAAGAGGAAACCA ATCACGTCCAAGGAATGGTACTGGTACCAGGTGAGGTCGTG GGCTGCGGGGCGCAGGTGTGGCGCGCCCTTGTGCCTCAT | 4029 |
| | GGTACCAGTACCATTCC | 4030 |
| | GGAATGGTACTGGTACC | 4031 |
| Crigler-Najjar syndrome 1 Ser488Phe TCC-UC | ACAAGGGCGCGCCACACCTGCGCCCCGCAGCCCACGACCT CACCTGGTACCAGTACCATTCCTTGGACGTGATTGGTTTCCT CTTGGCCGTCGTGCTGACAGTGGCCTTCATCACCTTTAA | 4032 |
| | TTAAAGGTGATGAAGGCCACTGTCAGCACGACGGCCAAGAG GAAACCAATCACGTCCAAGGAATGGTACTGGTACCAGGTGAG GTCGTGGGCTGCGGGGCGCAGGTGTGGCGCGCCCTTGT | 4033 |
| | GTACCATTCCTTGGACG | 4034 |
| | CGTCCAAGGAATGGTAC | 4035 |

EXAMPLE 23

Alzheimer's Disease—Amyloid Precursor Protein (APP)

Over the past few decades Alzheimer's disease (AD), once considered a rare disorder, has become recognized as a major public health problem. Although there is no agreement on the exact prevalence of Alzheimer's disease, in part due to difficulties of diagnosis, studies consistently point to an exponential rise in prevalence of this disease with age. After age 65, the percentage of affected people approximately doubles with every decade of life, regardless of definition. Among people age 85 or older, studies suggest that 25 to 35 percent have dementia, including Alzheimer's disease; one study reports that 47.2 percent of people over age 85 have Alzheimer's disease, exclusive of other dementias.

Alzheimer's disease progressively destroys memory, reason, judgment, language, and, eventually, the ability to carry out even the simplest tasks. Anatomic changes associated with Alzheimer's disease begin in the entorhinal cortex, proceed to the hippocampus, and then gradually spread to other regions, particularly the cerebral cortex. Chief among such anatomic changes are the presence of characteristic extracellular plaques and internal neurofibrillary tangles.

At least four genes have been identified to date that contribute to development of Alzheimer's disease: AD1 is caused by mutations in the amyloid precursor gene (APP); AD2 is associated with a particular allele of APOE (see Example 20); AD3 is caused by mutation in a gene encoding a 7-transmembrane domain protein, presenilin-1 (PSEN1), and AD4 is caused by mutation in a gene that encodes a similar 7-transmembrane domain protein, presenilin-2 (PSEN2). The attached table discloses

TABLE 30

APP Mutations and Genome-Correcting Oligos

| Clinical Phenotype & Mutation | Correcting Oligos | SEQ ID NO: |
|---|---|---|
| Alzheimer disease Glu665Asp GAG-GAC | CTGCATACTTTAATTATGATGTAATACAGGTTCTGGGTTGACA AATATCAAGACGGAGGAGATCTCTGAAGTGAAGATGGATGCA GAATTCCGACATGACTCAGGATATGAAGTTCATCAT | 4036 |
| | ATGATGAACTTCATATCCTGAGTCATGTCGGAATTCTGCATCC | 4037 |

TABLE 30-continued

APP Mutations and Genome-Correcting Oligos

| Clinical Phenotype & Mutation | Correcting Oligos | SEQ ID NO: |
|---|---|---|
| | ATCTTCACTTCAGAGATCTCCTCCGTCTTGATATTTGTCAACC CAGAACCTGTATTACATCATAATTAAAGTATGCAG | |
| | ACGGAGGAGATCTCTGA | 4038 |
| | TCAGAGATCTCCTCCGT | 4039 |
| Alzheimer disease Ala692Gly GCA-GGA | ATTATATTGCATTTAGAAATTAAAATTCTTTTTCTTAATTTGTTTT CAAGGTGTTCTTTGCAGAAGATGTGGGTTCAAACAAAGGTGC AATCATTGGACTCATGGTGGGCGGTGTTGTCAT | 4040 |
| | ATGACAACACCGCCCACCATGAGTCCAATGATTGCACCTTTG TTTGAACCCACATCTTCTGCAAAGAACACCTTGAAAACAAATT AAGAAAAAGAATTTTAATTTCTAAATGCAATATAAT | 4041 |
| | GTTCTTTGCAGAAGATG | 4042 |
| | CATCTTCTGCAAAGAAC | 4043 |
| Alzheimer disease Glu693Gln GAA-CAA | TATATTGCATTTAGAAATTAAAATTCTTTTTCTTAATTTGTTTTC AAGGTGTTCTTTGCAGAAGATGTGGGTTCAAACAAAGGTGCA ATCATTGGACTCATGGTGGGCGGTGTTGTCATAG | 4044 |
| | CTATGACAACACCGCCCACCATGAGTCCAATGATTGCACCTT TGTTTGAACCCACATCTTCTGCAAAGAACACCTTGAAAACAAA TTAAGAAAAAGAATTTTAATTTCTAAATGCAATATA | 4045 |
| | TCTTTGCAGAAGATGTG | 4046 |
| | CACATCTTCTGCAAAGA | 4047 |
| Alzheimer disease Glu693Gly GAA-GGA | ATATTGCATTTAGAAATTAAAATTCTTTTTCTTAATTTGTTTTCA AGGTGTTCTTTGCAGAAGATGTGGGTTCAAACAAAGGTGCAA TCATTGGACTCATGGTGGGCGGTGTTGTCATAGC | 4048 |
| | GCTATGACAACACCGCCCACCATGAGTCCAATGATTGCACCT TTGTTTGAACCCACATCTTCTGCAAAGAACACCTTGAAAACAA ATTAAGAAPAAGAATTTTAATTTCTAAATGCAATAT | 4049 |
| | CTTTGCAGAAGATGTGG | 4050 |
| | CCACATCTTCTGCAAAG | 4051 |
| Alzheimer disease Ala713Thr GCG-ACG | GAAGATGTGGGTTCAAACAAAGGTGCAATCATTGGACTCATG GTGGGCGGTGTTGTCATAGCGACAGTGATCGTCATCACCTTG GTGATGCTGAAGAAGAAACAGTACACATCCATTCATC | 4052 |
| | GATGAATGGATGTGTACTGTTTCTTCTTCAGCATCACCAAGGT GATGACGATCACTGTCGCTATGACAACACCGCCCACCATGAG TCCAATGATTGCACCTTTGTTTGAACCCACATCTT | 4053 |
| | TTGTCATAGCGACAGTG | 4054 |
| | CACTGTCGCTATGACAA | 4055 |
| Schizophrenia Ala713Val GCG-GTG | AAGATGTGGGTTCAAACAAAGGTGCAATCATTGGACTCATGG TGGGCGGTGTTGTCATAGCGACAGTGATCGTCATCACCTTGG TGATGCTGAAGAAGAAACAGTACACATCCATTCATCA | 4056 |
| | TGATGAATGGATGTGTACTGTTTCTTCTTCAGCATCACCAAGG TGATGACGATCACTGTCGCTATGACAACACCGCCCACCATGA GTCCAATGATTGCACCTTTGTTTGAACCCACATCTT | 4057 |
| | TGTCATAGCGACAGTGA | 4058 |
| | TCACTGTCGCTATGACA | 4059 |
| Alzheimer disease Val715Met GTG-ATG | GTGGGTTCAAACAAAGGTGCAATCATTGGACTCATGGTGGGC GGTGTTGTCATAGCGACAGTGATCGTCATCACCTTGGTGATG CTGAAGAAGAAACAGTACACATCCATTCATCATGGTG | 4060 |
| | CACCATGATGAATGGATGTGTACTGTTTCTTCTTCAGCATCAC CAAGGTGATGACGATCACTGTCGCTATGACAACACCGCCCAC CATGAGTCCAATGATTGCACCTTTGTTTGAACCCAC | 4061 |

TABLE 30-continued

APP Mutations and Genome-Correcting Oligos

| Clinical Phenotype & Mutation | Correcting Oligos | SEQ ID NO: |
|---|---|---|
| | TAGCGACAGTGATCGTC | 4062 |
| | GACGATCACTGTCGCTA | 4063 |
| Alzheimer disease Ile716Val ATC-GTC | GGTTCAAACAAAGGTGCAATCATTGGACTCATGGTGGGCGGT GTTGTCATAGCGACAGTGATCGTCATCACCTTGGTGATGCTG AAGAAGAAACAGTACACATCCATTCATCATGGTGTGG | 4064 |
| | CCACACCATGATGAATGGATGTGTACTGTTTCTTCTTCAGCAT CACCAAGGTGATGACGATCACTGTCGCTATGACAACACCGCC CACCATGAGTCCAATGATTGCACCTTTGTTTGAACC | 4065 |
| | CGACAGTGATCGTCATC | 4066 |
| | GATGACGATCACTGTCG | 4067 |
| Alzheimer disease Val717Gly GTC-GGC | CAAACAAAGGTGCAATCATTGGACTCATGGTGGGCGGTGTTG TCATAGCGACAGTGATCGTCATCACCTTGGTGATGCTGAAGA AGAAACAGTACACATCCATTCATCATGGTGTGGTGGA | 4068 |
| | TCCACCACACCATGATGAATGGATGTGTACTGTTTCTTCTTCA GCATCACCAAGGTGATGACGATCACTGTCGCTATGACAACAC CGCCCACCATGAGTCCAATGATTGCACCTTTGTTTG | 4069 |
| | AGTGATCGTCATCACCT | 4070 |
| | AGGTGATGACGATCACT | 4071 |
| Aizheimer disease Val17Ile GTC-ATC | TCAAACAAAGGTGCAATCATTGGACTCATGGTGGGCGGTGTT GTCATAGCGACAGTGATCGTCATCACCTTGGTGATGCTGAAG AAGAAACAGTACACATCCATTCATCATGGTGTGGTGG | 4072 |
| | CCACCACACCATGATGAATGGATGTGTACTGTTTCTTCTTCAG CATCACCAAGGTGATGACGATCACTGTCGCTATGACAACACC GCCCACCATGAGTCCAATGATTGCACCTTTGTTTGA | 4073 |
| | CAGTGATCGTCATCACC | 4074 |
| | GGTGATGACGATCACTG | 4075 |
| Alzheimer disease Val717Phe GTC-TTC | TCAAACAAAGGTGCAATCATTGGACTCATGGTGGGCGGTGTT GTCATAGCGACAGTGATCGTCATCACCTTGGTGATGCTGAAG AAGAAACAGTACACATCCATTCATCATGGTGTGGTGG | 4076 |
| | CCACCACACCATGATGAATGGATGTGTACTGTTTCTTCTTCAG CATCACCAAGGTGATGACGATCACTGTCGCTATGACAACACC GCCCACCATGAGTCCAATGATTGCACCTTTGTTTGA | 4077 |
| | CAGTGATCGTCATCACC | 4078 |
| | GGTGATGACGATCACTG | 4079 |
| Alzheimer disease Leu723Pro CTG-CCG | TTGGACTCATGGTGGGCGGTGTTGTCATAGCGACAGTGATCG TCATCACCTTGGTGATGCTGAAGAAGAAACAGTACACATCCAT TCATCATGGTGTGGTGGAGGTAGGTAAACTTGACTG | 4080 |
| | CAGTCAAGTTTACCTACCTCCACCACACCATGATGAATGGAT GTGTACTGTTTCTTCTTCAGCATCACCAAGGTGATGACGATCA CTGTCGCTATGACAACACCGCCCACCATGAGTCCAA | 4081 |
| | GGTGATGCTGAAGAAGA | 4082 |
| | TCTTCTTCACCATCACC | 4083 |

EXAMPLE 24

Alzheimer's Disease—Presenilin-1 (PSEN1)

The attached table discloses the correcting oligonucleotide base sequences for the PSEN1 oligonucleotides of the invention.

TABLE 31

PSEN1 Mutations and Genome-Correcting Oligos

| Clinical Phenotype & Mutation | Correcting Oligos | SEQ ID NO: |
| --- | --- | --- |
| Alzheimer disease Ala79Val GCC-GTC | CCCGGCAGGTGGTGGAGCAAGATGAGGAAGAAGATGAGGAG CTGACATTGAAATATGGCGCCAAGCATGTGATCATGCTCTTTG TCCCTGTGACTCTCTGCATGGTGGTGGTCGTGGCTAC | 4084 |
|  | GTAGCCACGACCACCACCATGCAGAGAGTCACAGGGACAAA GAGCATGATCACATGCTTGGCGCCATATTTCAATGTCAGCTC CTCATCTTCTTCCTCATCTTGCTCCACCACCTGCCGGG | 4085 |
|  | ATATGGCGCCAAGCATG | 4086 |
|  | CATGCTTGGCGCCATAT | 4087 |
| Alzheimer disease Val82Leu tGTG-CTG | GTGGTGGAGCAAGATGAGGAAGAAGATGAGGAGCTGACATT GAAATATGGCGCCAAGCATGTGATCATGCTCTTTGTCCCTGT GACTCTCTGCATGGTGGTGGTCGTGGCTACCATTAAGT | 4088 |
|  | ACTTAAGGTAGCCACGACCACCACCATGCAGAGAGTCACAG GGACAAAGAGCATGATCACATGCTTGGCGCCATATTTCAATG TCAGCTCCTCATCTTCTTCCTCATCTTGCTCCACCAC | 4089 |
|  | CCAAGCATGTGATCATG | 4090 |
|  | CATGATCACATGCTTGG | 4091 |
| Alzheimer disease Val96Phe gGTC-TTC | AAATATGGCGCCAAGCATGTGATCATGCTCTTTGTCCCTGTG ACTCTCTGCATGGTGGTGGTCGTGGCTACCATTAAGTCAGTC AGCTTTTATACCCGGAAGGATGGGCAGCTGTACGTAT | 4092 |
|  | ATACGTACAGCTGCCCATCCTTCCGGGTATAAAAGCTGACTG ACTTAATGGTAGCCACGACCACCACCATGCAGAGAGTCACAG GGACAAAGAGCATGATCACATGCTTGGCGCCATATTT | 4093 |
|  | TGGTGGTGGTCGTGGCT | 4094 |
|  | AGCCACGACCACCACCA | 4095 |
| Alzheimer disease Phe105Leu TTTt-TTG | CTTTGTCCCTGTGACTCTCTGCATGGTGGTGGTCGTGGCTAC CATTAAGTCAGTCAGCTTTTATACCCGGAAGGATGGGCAGCT GTACGTATGAGTTTTGTTTTATTATTCTCAAAGCCAG | 4096 |
|  | CTGGCTTTGAGAATAATAAAACAAAACTCATACGTACAGCTGC CCATCCTTCCGGGTATAAAAGCTGACTGACTTAATGGTAGCC ACGACCACCACCATGCAGAGAGTCACAGGGACAAAG | 4097 |
|  | GTCAGCTTTTATACCCG | 4098 |
|  | CGCGTATAAAAGCTGAC | 4099 |
| Alzheimer disease Thr116Asn ACC-AAC | TGGTGATCTCCATTAACACTGACCTAGGGCTTTTGTGTTTGTT TTATTGTAGAATCTATACCCCATTCACAGAAGATACCGAGACT GTGGGCCAGAGAGCCCTGCACTCAATTCTGAATGC | 4100 |
|  | GCATTCAGAATTGAGTGCAGGGCTCTCTGGCCCACAGTCTCG GTATCTTCTGTGAATGGGGTATAGATTCTACAATAAAACAAAC ACAAAAGCCCTAGGTCAGTGTTAATGGAGATCACCA | 4101 |
|  | AATCTATACCCCATTCA | 4102 |
|  | TGAATGGGGTATAGATT | 4103 |
| Alzheimer disease Pro117Leu CCA-CTA | TGATCTCCATTAACACTGACCTAGGGCTTTTGTGTTTGTTTTAT TGTAGAATCTATACCCCATTCACAGAAGATACCGAGACTGTG GGCCAGAGAGCCCTGCACTCAATTCTGAATGCTGC | 4104 |

TABLE 31-continued

PSEN1 Mutations and Genome-Correcting Oligos

| Clinical Phenotype & Mutation | Correcting Oligos | SEQ ID NO: |
|---|---|---|
| | GCAGCATTCAGAATTGAGTGCAGGGCTCTCTGGCCCACAGTC TCGGTATCTTCTGTGAATGGGGTATAGATTCTACAATAAAACA AACACAAAAGCCCTAGGTCAGTGTTAATGGAGATCA | 4105 |
| | CTATACCCCATTCACAG | 4106 |
| | CTGTGAATGGGGTATAG | 4107 |
| Alzheimer disease Glu120Asp GAAg-GAT | TAACACTGACCTAGGGCTTTTGTGTTTGTTTTATTGTAGAATCT ATACCCCATTCACAGAAGATACCGAGACTGTGGGCCAGAGAG CCCTGCACTCAATTCTGAATGCTGCCATCATGATC | 4108 |
| | GATCATGATGGCAGCATTCAGAATTGAGTGCAGGGCTCTCTG GCCCACAGTCTCGGTATCTTCTGTGAATGGGGTATAGATTCT ACAATAAAACAAACACAAAAGCCCTAGGTCAGTGTTA | 4109 |
| | TTCACAGAAGATACCGA | 4110 |
| | TCGGTATCTTCTGTGAA | 4111 |
| Alzheimer disease Glu120Asp GAAg-GAC | TAACACTGACCTAGGGCTTTTGTGTTTGTTTTATTGTAGAATCT ATACCCCATTCACAGAAGATACCGAGACTGTGGGCCAGAGAG CCCTGCACTCAATTCTGAATGCTGCCATCATGATC | 4112 |
| | GATCATGATGGCAGCATTCAGAATTGAGTGCAGGGCTCTCTG GCCCACAGTCTCGGTATCTTCTGTGAATGGGGTATAGATTCT ACAATAAAACAAACACAAAAGCCCTAGGTCAGTGTTA | 4113 |
| | TTCACAGAAGATACCGA | 4114 |
| | TCGGTATCTTCTGTGAA | 4115 |
| Alzheimer disease Glu120Lys aGAA-AAA | ATTAACACTGACCTAGGGCTTTTGTGTTTGTTTATTGTAGAAT CTATACCCCATTCACAGAAGATACCGAGACTGTGGGCCAGAG AGCCCTGCACTCAATTCTGAATGCTGCCATCATGA | 4116 |
| | TCATGATGGCAGCATTCAGAATTGAGTGCAGGGCTCTCTGGC CCACAGTCTCGGTATCTTCTGTGAATGGGGTATAGATTCTACA ATAAAACAAACACAAAAGCCCTAGGTCAGTGTTAAT | 4117 |
| | CATTCACAGAAGATACC | 4118 |
| | GGTATCTTCTGTGAATG | 4119 |
| Alzheimer disease Glu123Lys cGAG-AAG | GACCTAGGGCTTTTGTGTTTGTTTTATTGTAGAATCTATACCC CATTCACAGAAGATACCGAGACTGTGGGCCAGAGAGCCCTGT CACTCAATTCTGAATGCTGCCATCATGATCACTGTCA | 14120 |
| | TGACACTGATCATGATGGCAGCATTCAGAATTGAGTGCAGGG CTCTCTGGCCCACAGTCTCGGTATCTTCTGTGAATGGGGTAT AGATTCTACAATAAAACAAACACAAAAGCCCTAGGTC | 4121 |
| | AAGATACCGAGACTGTG | 4122 |
| | CACAGTCTCGGTATCTT | 4123 |
| Alzheimer disease Asn135Asp gAAT-GAT | TATACCCCATTCACAGAAGATACCGAGACTGTGGGCCAGAGA GCCCTGCACTCAATTCTGAATGCTGCCATCATGATCAGTGTC ATTGTTGTCATGACTATCCTCCTGGTGGTTCTGTATA | 4124 |
| | TATACAGAACCACCAGGAGGATAGTCATGACAACAATGACAC TGATCATGATGGCAGCATTCAGAATTGAGTGCAGGGCTCTCT GGCCCACAGTCTCGGTATCTTCTGTGAATGGGGTATA | 4125 |
| | CAATTCTGAATGCTGCC | 4126 |
| | GGCAGCATTCAGAATTG | 4127 |
| Alzheimer disease Met139Ile ATGa-ATA | AGAAGATACCGAGACTGTGGGCCAGAGAGCCCTGCACTCAA TTCTGAATGCTGCCATCATGATCAGTGTCATTGTTGTCATGAC TATCCTCCTGGTGGTTCTGTATAAATACAGGTGCTAT | 4128 |
| | ATAGCACCTGTATTTATACAGAACCACCAGGAGGATAGTCATG ACAACAATGACACTGATCATGATGGCAGCATTCAGAATTGAGT | 4129 |

TABLE 31-continued

PSEN1 Mutations and Genome-Correcting Oligos

| Clinical Phenotype & Mutation | Correcting Oligos | SEQ ID NO: |
|---|---|---|
| | GCAGGGCTCTCTGGCCCACAGTCTCGGTATCTTCT | |
| | GCCATCATGATCAGTGT | 4130 |
| | ACACTGATCATGATGGC | 4131 |
| Alzheimer disease Met139Lys ATG-AAG | CAGAAGATACCGAGACTGTGGGCCAGAGAGCCCTGCACTCA ATTCTGAATGCTGCCATCATGATCAGTGTCATTGTTGTCATGA CTATCCTCCTGGTGGTTCTGTATAAATACAGGTGCTA | 4132 |
| | TAGCACCTGTATTTATACAGAACCACCAGGAGGATAGTCATGA CAACAATGACACTGATCATGATGGCAGCATTCAGAATTGAGT GCAGGGCTCTCTGGCCCACAGTCTCGGTATCTTCTG | 4133 |
| | TGCCATCATGATCAGTG | 4134 |
| | CACTGATCATGATGGCA | 4135 |
| Alzheimer disease Met139Thr ATG-ACG | CAGAAGATACCGAGACTGTGGGCCAGAGAGCCCTGCACTCA ATTCTGAATGCTGCCATCATGATCAGTGTCATTGTTGTCATGA CTATCCTCCTGGTGGTTCTGTATAAATACAGGTGCTA | 4136 |
| | TAGCACCTGTATTTATACAGAACCACCAGGAGGATAGTCATGA CAACAATGACACTGATCATGATGGCAGCATTCAGAATTGAGT GCAGGGCTCTCTGGCCCACAGTCTCGGTATCTTCTG | 4137 |
| | TGCCATCATGATCAGTG | 4138 |
| | CACTGATCATGATGGCA | 4139 |
| Alzheimer disease Met139Val cATG-GTG | ACAGAAGATACCGAGACTGTGGGCCAGAGAGCCCTGCACTC AATTCTGAATGCTGCCATCATGATCAGTGTCATTGTTGTCATG ACTATCCTCCTGGTGGTTCTGTATAAATACAGGTGCT | 4140 |
| | AGCACCTGTATTTATACAGAACCACCAGGAGGATAGTCATGA CAACAATGACACTGATCATGATGGCAGCATTCAGAATTGAGT GCAGGGCTCTCTGGCCCACAGTCTCGGTATCTTCTGT | 4141 |
| | CTGCCATCATGATCAGT | 4142 |
| | ACTGATCATGATGGCAG | 4143 |
| Alzheimer disease Ile143Phe cATT-TTT | GAGACTGTGGGCCAGAGAGCCCTGCACTCAATTCTGAATGCT GCCATCATGATCAGTGTCATTGTTGTCATGACTATCCTCCTGG TGGTTCTGTATAAATACAGGTGCTATAAGGTGAGCA | 4144 |
| | TGCTCACCTTATAGCACCTGTATTTATACAGAACCACCAGGAG GATAGTCATGACAACAATGACACTGATCATGATGGCAGCATTC AGAATTGAGTGCAGGGCTCTCTGGCCCACAGTCTC | 4145 |
| | TCAGTGTCATTGTTGTC | 4146 |
| | GACAACAATGACACTGA | 4147 |
| Alzheimer disease Ile143Thr ATT-ACT | AGACTGTGGGCCAGAGAGCCCTGCACTCAATTCTGAATGCTG CCATCATGATCAGTGTCATTGTTGTCATGACTATCCTCCTGGT GGTTCTGTATAAATACAGGTGCTATAAGGTGAGCAT | 4148 |
| | ATGCTCACCTTATAGCACCTGTATTTATACAGAACCACCAGGA GGATAGTCATGACAACAATGACACTGATCATGATGGCAGCAT TCAGAATTGAGTGCAGGGCTCTCTGGCCCACAGTCT | 4149 |
| | CAGTGTCATTGTTGTCA | 4150 |
| | TGACAACAATGACACTG | 4151 |
| Alzheimer disease Met146Ile ATGa-ATA | CCAGAGAGCCCTGCACTCAATTCTGAATGCTGCCATCATGAT CAGTGTCATTGTTGTCATGACTATCCTCCTGGTGGTTCTGTAT AAATACAGGTGCTATAAGGTGAGCATGAGACACAGA | 4152 |
| | TCTGTGTCTCATGCTCACCTTATAGCACCTGTATTTATACAGA ACCACCAGGAGGATAGTCATGACAACAATGACACTGATCATG ATGGCAGCATTCAGAATTGAGTGCAGGGCTCTCTGG | 4153 |

TABLE 31-continued

PSEN1 Mutations and Genome-Correcting Oligos

| Clinical Phenotype & Mutation | Correcting Oligos | SEQ ID NO: |
|---|---|---|
| | GTTGTCATGACTATCCT | 4154 |
| | AGGATAGTCATGACAAC | 4155 |
| Alzheimer disease Met146Ile ATGa-ATC | CCAGAGAGCCCTGCACTCAATTCTGAATGGTGCCATCATGAT CAGTGTCATTGTTGTCATGACTATCCTCCTGGTGGTTCTGTAT AAATACAGGTGCTATAAGGTGAGCATGAGACACAGA | 4156 |
| | TCTGTGTCTCATGCTCACCTTATAGCACCTGTATTTATACAGA ACCACCAGGAGGATAGTCATGACAACAATGACACTGATCATG ATGGCAGCATTCAGAATTGAGTGCAGGGCTCTCTGG | 4157 |
| | GTTGTCATGACTATCCT | 4158 |
| | AGGATAGTCATGACAAC | 4159 |
| Alzheimer disease Met146Leu cATG-UG | GGCCAGAGAGCCCTGCACTCAATTCTGAATGCTGCCATCATG ATCAGTGTCATTGTTGTCATGACTATCCTCCTGGTGGTTCTGT ATAAATACAGGTGCTATAAGGTGAGCATGAGACACA | 4160 |
| | TGTGTCTCATGCTCACCUATAGCACCTGTATTTATACAGAAC CACCAGGAGGATAGTCATGACAACAATGACACTGATCATGAT GGCAGCATTCAGAATTGAGTGCAGGGCTCTCTGGCC | 4161 |
| | TTGTTGTCATGACTATC | 4162 |
| | GATAGTCATGACAACAA | 4163 |
| Alzheimer disease Met146Val cATG-GTG | GGCCAGAGAGCCCTGCACTCAATTCTGAATGCTGCCATCATG ATCAGTGTCATTGTTGTCATGACTATCCTCCTGGTGGTTCTGT ATAAATACAGGTGCTATAAGGTGAGCATGAGACACA | 4164 |
| | TGTGTCTCATGCTCACCTTATAGCACCTGTATTTATACAGAAC CACCAGGAGGATAGTCATGACAACAATGACACTGATCATGAT GGCAGCATTCAGAATTGAGTGCAGGGCTCTCTGGCC | 4165 |
| | TTGTTGTCATGACTATC | 4166 |
| | GATAGTCATGACAACAA | 4167 |
| Alzheimer disease Thr147Ile ACT-ATT | AGAGAGCCCTGCACTCAATTCTGAATGCTGCCATCATGATCA GTGTCATTGTTGTCATGACTATCCTCCTGGTGGTTCTGTATAA ATACAGGTGCTATAAGGTGAGCATGAGACACAGATC | 4168 |
| | GATCTGTGTCTCATGCTCACCTTATAGCACCTGTATTTATACA GAACCACCAGGAGGATAGTCATGACAACAATGACACTGATCA TGATGGCAGCATTCAGAATTGAGTGCAGGGCTCTCT | 4169 |
| | TGTCATGACTATCCTCC | 4170 |
| | GGAGGATAGTCATGACA | 4171 |
| Alzheimer disease His163Arg CAT-CGT | CTTTTTAAGGGTTGTGGGACCTGTTAATTATATTGAAATGCTTT CTTTTCTAGGTCATCCATGCCTGGCTTATTATATCATCTCTATT GTTGCTGTTCTTTTTTTCATTCATTTACTTGGG | 4172 |
| | CCCAAGTAAATGAATGAAAAAAAGAACAGCAACAATAGAGATG ATATAATAAGCCAGGCATGGATGACCTAGAAAAGAAAGCATTT CAATATAATTAACAGGTCCCACAACCCTTAAAAAG | 4173 |
| | GGTCATCCATGCCTGGC | 4174 |
| | GCCAGGCATGGATGACC | 4175 |
| Alzheimer disease His163Tyr cCAT-TAT | ACTTTTTAAGGGTTGTGGGACCTGTTAATTATATTGAAATGCTT TCTTTTCTAGGTCATCCATGCCTGGCTTATTATATCATCTCTAT TGTTGCTGTTTCTTTTTTTCATTCATTTACTTGG | 4176 |
| | CCAAGTAAATGAATGAAAAAAAGAACAGCAACAATAGAGATGA TATAATAAGCCAGGCATGGATGACCTAGAAAAGAAAGCATTTC AATATAATTAACAGGTCCCACAACCCTTAAAAAGT | 4177 |
| | AGGTCATCCATGCCTGG | 4178 |
| | CCAGGCATGGATGACCT | 4179 |

TABLE 31-continued

PSEN1 Mutations and Genome-Correcting Oligos

| Clinical Phenotype & Mutation | Correcting Oligos | SEQ ID NO: |
|---|---|---|
| Alzheimer disease Trp165Cys TGGc-TGC | AGGGTTGTGGGACCTGTTAATTATATTGAAATGCTTTCTTTTCT AGGTCATCCATGCCTG<u>G</u>CTTATTATATCATCTCTATTGTTGCT GTTCTTTTTTTCATTCATTTACTTGGGGTAAGTT | 4180 |
| | AACTTACCCCAAGTAAATGAATGAAAAAAAGAACAGCAACAAT AGAGATGATATAATAAG<u>C</u>CAGGCATGGATGACCTAGAAAAGA AAGCATTTCAATATAATTAACAGGTCCCACAACCCT | 4181 |
| | CATGCCTG<u>G</u>CTTATTAT | 4182 |
| | ATAATAAG<u>C</u>CAGGCATG | 4183 |
| Alzheimer disease Ser169Leu TCA-TTA | ACCTGTTAATTATATTGAAATGCTTTCTTTTCTAGGTCATCCAT GCCTGGCTTATTATAT<u>C</u>ATCTCTATTGTTGCTGTTCTTTTTTTC ATTCATTTACTTGGGGTAAGTTGTGAAATTTTT | 4184 |
| | AAAAATTTCACAACTTACCCCAAGTAAATGAATGAAAAAAAGAA CAGCAACAATAGAGAT<u>G</u>ATATAATAAGCCAGGCATGGATGAC CTAGAAAAGAAAGCATTTCAATATAATTAACAGGT | 4185 |
| | TATTATAT<u>C</u>ATCTCTAT | 4186 |
| | ATAGAGAT<u>G</u>ATATAATA | 4187 |
| Alzheimer disease Leu171Pro CTA-CCA | TAATTATATTGAAATGCTTTCTTTTCTAGGTCATCCATGCCTGG CTTATTATATCATCTC<u>T</u>ATTGTTGCTGTTCTTTTTTTCATTCATT TACTTGGGGTAAGTTGTGAAATTTTTGGTCTG | 4188 |
| | CAGACCAAAAATTTCACAACTTACCCCAAGTAAATGAATGAAA AAAAGAACAGCAACAAT<u>A</u>GAGATGATATAATAAGCCAGGCAT GGATGACCTAGAAAAGAAAGCATTTCAATATAATTA | 4189 |
| | ATCATCTC<u>T</u>ATTGTTGC | 4190 |
| | GCAACAAT<u>A</u>GAGATGAT | 4191 |
| Alzheimer disease Leu173Trp TTG-TGG | TATTGAAATGCTTTCTTTTCTAGGTCATCCATGCCTGGCTTATT ATATCATCTCTATT<u>G</u>TTGCTGTTCTTTTTTTCATTCATTTACTTG GGGTAAGTTGTGAAATTTTTGGTCTGTCTTTC | 4192 |
| | GAAAGACAGACCAAAAATTTCACAACTTACCCCAAGTAAATGA ATGAAAAAAGAACAGC<u>A</u>ACAATAGAGATGATATAATAAGCCA GGCATGGATGACCTAGAAAAGAAAGCATTCAATA | 4193 |
| | TCTATTGT<u>T</u>GCTGTTCT | 4194 |
| | AGAACAGC<u>A</u>ACAATAGA | 4195 |
| Alzheimer disease Gly209Arg gGGA-AGA | TATAACGTTGCTGTGGACTACATTACTGTTGCACTCCTGATCT GGAATTTTGGTGTGGTG<u>G</u>GAATGATTTCCATTCACTGGAAAG GTCCACTTCGACTCCAGCAGGCATATCTCATTATGA | 4196 |
| | TCATAATGAGATATGCCTGCTGGAGTCGAAGTGGACCTTTCC AGTGAATGGAAATCATTC<u>C</u>CACCACACCAAAATTCCAGATCAG GAGTGCAACAGTAATGTAGTCCACAGCAACGTTATA | 4197 |
| | GTGTGGTG<u>G</u>GAATGATT | 4198 |
| | AATCATTC<u>C</u>CACCACAC | 4199 |
| Alzheimer disease Gly209Val GGA-GTA | ATAACGTTGCTGTGGACTACATTACTGTTGCACTCCTGATCTG GAATTTTGGTGTGGTGG<u>G</u>AATGATTTCCATTCACTGGAAAGGT CCACTTCGACTCCAGCAGGCATATCTCATTATGAT | 4200 |
| | ATCATAATGAGATATGCCTGCTGGAGTCGAAGTGGACCTTTC CAGTGAATGGAAATCATT<u>C</u>CCACCACACCAAAATTCCAGATCA GGAGTGCAACAGTAATGTAGTCCACAGCAACGTTAT | 4201 |
| | TGTGGTGG<u>G</u>AATGATTT | 4202 |
| | AAATCATT<u>C</u>CCACCACA | 4203 |
| Alzheimer disease Ile213Thr | TGGACTACATTACTGTTGCACTCCTGATCTGGAATTTTGGTGT GGTGGGAATGATTTCCA<u>T</u>TCACTGGAAAGGTCCACTTCGACT | 4204 |

TABLE 31-continued

PSEN1 Mutations and Genome-Correcting Oligos

| Clinical Phenotype & Mutation | Correcting Oligos | SEQ ID NO: |
|---|---|---|
| ATT-ACT | CCAGCAGGCATATCTCATTATGATTAGTGCCCTCAT | |
| | ATGAGGGCACTAATCATAATGAGATATGCCTGCTGGAGTCGAAGTGGACCTTTCCAGTGAATGGAAATCATTCCCACCACACCAAAATTCCAGATCAGGAGTGCAACAGTAATGTAGTCCA | 4205 |
| | GATTTCCATTCACTGGA | 4206 |
| | TCCAGTGAATGGAAATC | 4207 |
| Alzheimer disease Leu219Pro CTT-CCT | CACTCCTGATCTGGAATTTTGGTGTGGTGGGAATGATTTCCATTCACTGGAAAGGTCCACTTCGACTCCAGCAGGCATATCTCATTATGATTAGTGCCCTCATGGCCCTGGTGTTTATCAA | 4208 |
| | TTGATAAACACCAGGGCCATGAGGGCACTAATCATAATGAGATATGCCTGCTGGAGTCGAAGTGGACCTTTCCAGTGAATGGAAATCATTCCCACCACACCAAAATTCCAGATCAGGAGTG | 4209 |
| | AGGTCCACTTCGACTCC | 4210 |
| | GGAGTCGAAGTGGACCT | 4211 |
| Alzheimer disease Ala231Thr tGCC-ACC | ATTTCCATTCACTGGAAAGGTCCACTTCGACTCCAGCAGGCATATCTCATTATGATTAGTGCCCTCATGGCCCTGGTGTTTATCAAGTACCTCCCTGAATGGACTGCGTGGCTCATCTTGG | 4212 |
| | CCAAGATGAGCCACGCAGTCCATTCAGGGAGGTACTTGATAAACACCAGGGCCATGAGGGCACTAATCATAATGAGATATGCCTGCTGGAGTCGAAGTGGACCTTTCCAGTGAATGGAAAT | 4213 |
| | TGATTAGTGCCCTCATG | 4214 |
| | CATGAGGGCACTAATCA | 4215 |
| Alzheimer disease Ala231Val GCC-GTC | TTTCCATTCACTGGAAAGGTCCACTTCGACTCCAGCAGGCATATCTCATTATGATTAGTGCCCTCATGGCCCTGGTGTTTATCAAGTACCTCCCTGAATGGACTGCGTGGCTCATCTTGGC | 4216 |
| | GCCAAGATGAGCCACGCAGTCCATTCAGGGAGGTACTTGATAAACACCAGGGCCATGAGGGCACTAATCATAATGAGATATGCCTGCTGGAGTCGAAGTGGACCTTTCCAGTGAATGGAAA | 4217 |
| | GATTAGTGCCCTCATGG | 4218 |
| | CCATGAGGGCACTAATC | 4219 |
| Alzheimer disease Met233Thr ATG-ACG | TTCACTGGAAAGGTCCACTTCGACTCCAGCAGGCATATCTCATTATGATTAGTGCCCTCATGGCCCTGGTGTTTATCAAGTACCTCCCTGAATGGACTGCGTGGCTCATCTTGGCTGTGAT | 4220 |
| | ATCACAGCCAAGATGAGCCACGCAGTCCATTCAGGGAGGTACTTGATAAACACCAGGGCCATGAGGGCACTAATCATAATGAGATATGCCTGCTGGAGTCGAAGTGGACCTTCCAGTGAA | 4221 |
| | TGCCCTCATGGCCCTGG | 4222 |
| | CCAGGGCCATGAGGGCA | 4223 |
| Alzheimer disease Leu235Pro CTG-CCG | GGAAAGGTCCACTTCGACTCCAGCAGGCATATCTCATTATGATTAGTGCCCTCATGGCCCTGGTGTTTATCAAGTACCTCCCTGAATGGACTGCGTGGCTCATCTTGGCTGTGATTTCAGT | 4224 |
| | ACTGAAATCACAGCCAAGATGAGCCACGCAGTCCATTCAGGGAGGTACTTGATAAACACCAGGGCCATGAGGGCACTAATCATAATGAGATATGCCTGCTGGAGTCGAAGTGGACCTTTCC | 4225 |
| | CATGGCCCTGGTGTTTA | 4226 |
| | TAAACACCAGGGCCATG | 4227 |
| Alzheimer disease Ala246Glu GCG-GAG | TCATTATGATTAGTGCCCTCATGGCCCTGGTGTTTATCAAGTACCTCCCTGAATGGACTGCGTGGCTCATCTTGGCTGTGATTTCAGTATATGGTAAAACCCAAGACTGATAATTTGTTTG | 4228 |

TABLE 31-continued

PSEN1 Mutations and Genome-Correcting Oligos

| Clinical Phenotype & Mutation | Correcting Oligos | SEQ ID NO: |
|---|---|---|
| | CAAACAAATTATCAGTCTTGGGTTTTACCATATACTGAAATCAC AGCCAAGATGAGCCACG CAGTCCATTCAGGGAGGTACTTGAT AAACACCAGGGCCATGAGGGCACTAATCATAATGA | 4229 |
| | ATGGACTGCGTGGCTCA | 4230 |
| | TGAGCCACGCAGTCCAT | 4231 |
| Alzheimer disease Leu250Ser TTG-TCG | GTGCCCTCATGGCCCTGGTGTTTATCAAGTACCTCCCTGAAT GGACTGCGTGGCTCATCTTGGCTGTGATTTCAGTATATGGTA AAACCCAAGACTGATAATTTGTTTGTCACAGGAATGC | 4232 |
| | GCATTCCTGTGACAAACAAATTATCAGTCTTGGGTTTTACCAT ATACTGAAATCACAGCCAAGATGAGCCACGCAGTCCATTCAG GGAGGTACTTGATAAACACCAGGGCCATGAGGGCAC | 4233 |
| | GCTCATCTTGGCTGTGA | 4234 |
| | TCACAGCCAAGATGAGC | 4235 |
| Alzheimer disease Ala260Val GCT-GTT | AGTTTAGCCCATACATTTTATTAGATGTCTTTTATGTTTTTCTTT TTCTAGATTTAGTGGCTGTTTTGTGTCCGAAAGGTCCACTTCG TATGCTGGTTGAAACAGCTCAGGAGAGAAATGA | 4236 |
| | TCATTTCTCTCCTGAGCTGTTTCAACCAGCATACGAAGTGGAC CTTTCGGACACAAAACAGCCACTAAATCTAGAAAAAGAAAAAC ATAAAAGACATCTAATAAAATGTATGGGCTAAACT | 4237 |
| | TTTAGTGGCTGTTTTGT | 4238 |
| | ACAAAACAGCCACTAAA | 4239 |
| Alzheimer disease Leu262Phe TTGt-TTC | CCCATACATTTTATTAGATGTCTTTTATGTTTTTCTTTTCTAGA TTTAGTGGCTGTTTTGTGTCCGAAAGGTCCACTTCGTATGCTG GTTGAAACAGCTCAGGAGAGAAATGAAACGCTT | 4240 |
| | AAGCGTTTCATTTCTCTCCTGAGCTGTTTCAACCAGCATACGA AGTGGACCTTTCGGACACAAAACAGCCACTAAATCTAGAAAAA GAAAAACATAAAAGACATCTAATAAAATGTATGGG | 4241 |
| | GCTGTTTTGTGTCCGAA | 4242 |
| | TTCGGACACAAAACAGC | 4243 |
| Alzheimer disease Cys263Arg gTGT-CGT | CCATACATTTTATTAGATGTCTTTTATGTTTTCTTTTTCTAGAT TTAGTGGCTGTTTTGTGTCCGAAAGGTCCACTTCGTATGCTG GTTGAAACAGCTCAGGAGAGAAATGAAACGCTTT | 4244 |
| | AAAGCGTTTCATTTCTCTCCTGAGCTGTTTCAACCAGCATACG AAGTGGACCTTTCGGACACAAAACAGCCACTAAATCTAGAAA AAGAAAAACATAAAAGACATCTAATAAAATGTATGG | 4245 |
| | CTGTTTTGTGTCCGAAA | 4246 |
| | TTTCGGACACAAAACAG | 4247 |
| Alzheimer disease Pro264Leu CCG-CTG | ACATTTTATTAGATGTCTTTTATGTTTTTCTTTTTCTAGATTTAG TGGCTGTTTTGTGTCCGAAAGGTCCACTTCGTATGCTGGTTG AAACAGCTCAGGAGAGAAATGAAACGCTTTTTCC | 4248 |
| | GGAAAAAGCGTTTCATTTCTCTCCTGAGCTGTTTCAACCAGCA TACGAAGTGGACCTTTCGGACACAAAACAGCCACTAAATCTA GAAAAAGAAAAACATAAAAGACATCTAATAAAATGT | 4249 |
| | TTTGTGTCCGAAAGGTC | 4250 |
| | GACCTTTCGGACACAAA | 4251 |
| Alzheimer disease Arg269Gly tCGT-GGT | GTCTTTTATGTTTTTCTTTTTCTAGATTTAGTGGCTGTTTTGTG TCCGAAAGGTCCACTTCGTATGCTGGTTGAAACAGCTCAGGA GAGAAATGAAACGCTTTTTCCAGCTCTCATTTACT | 4252 |
| | AGTAAATGAGAGCTGGAAAAAGCGTTTCATTTCTCTCCTGAGC TGTTTCAACCAGCATACGAAGTGGACCTTTCGGACACAAAAC | 4253 |

TABLE 31-continued

PSEN1 Mutations and Genome-Correcting Oligos

| Clinical Phenotype & Mutation | Correcting Oligos | SEQ ID NO: |
|---|---|---|
| | AGCCACTAAATCTAGAAAAAGAAAAACATAAAAGAC | |
| | GTCCACTTCGTATGCTG | 4254 |
| | CAGCATACGAAGTGGAC | 4255 |
| Alzheimer disease Arg269His CGT-CAT | TCTTTTATGTTTTTCTTTTTCTAGATTTAGTGGCTGTTTTGTGTC CGAAAGGTCCACTTCGTATGCTGGTTGAAACAGCTCAGGAGA GAAATGAAACGCTTTTTCCAGCTCTCATTTACTC | 4256 |
| | GAGTAAATGAGAGCTGGAAAAAGCGTTTCATTTCTCTCCTGAG CTGTTTCAACCAGCATACGAAGTGGACCTTTCGGACACAAAA CAGCCACTAAATCTAGAAAAAGAAAAACATAAAAGA | 4257 |
| | TCCACTTCGTATGCTGG | 4258 |
| | CCAGCATACGAAGTGGA | 4259 |
| Alzheimer disease Arg278Thr AGA-ACA | TAGTGGCTGTTTTGTGTCCGAAAGGTCCACTTCGTATGCTGG TTGAAACAGCTCAGGAGAGAAATGAAACGCTTTTTCCAGCTCT CATTTACTCCTGTAAGTATTTGAGAATGATATTGAA | 4260 |
| | TTCAATATCATTCTCAAATACTTACAGGAGTAAATGAGAGCTG GAAAAAGCGTTTCATTTCTCTCCTGAGCTGTTTCAACCAGCAT ACGAAGTGGACCTTTCGGACACAAAACAGCCACTA | 4261 |
| | TCAGGAGAGAAATGAAA | 4262 |
| | TTTCATTTCTCTCCTGA | 4263 |
| Alzheimer disease Glu280Ala GAA-GCA | CTGTTTTGTGTCCGAAAGGTCCACTTCGTATGCTGGTTGAAAC AGCTCAGGAGAGAAATGAAACGCTTTTTCCAGCTCTCATTTAC TCCTGTAAGTATTTGAGAATGATATTGAATTAGTA | 4264 |
| | TACTAATTCAATATCATTCTCAAATACTTACAGGAGTAAATGAG AGCTGGAAAAAGCGTTTCATTTCTCTCCTGAGCTGTTTCAACC AGCATACGAAGTGGACCTTTCGGACACAAAACAG | 4265 |
| | GAGAAATGAAACGCTTT | 4266 |
| | AAAGCGTTTCATTTCTC | 4267 |
| Alzheimer disease Glu280Gly GAA-GGA | CTGTTTTGTGTCCGAAAGGTCCACTTCGTATGCTGGTTGAAAC AGCTCAGGAGAGAAATGAAACGCTTTTTCCAGCTCTCATTTAC TCCTGTAAGTATTTGAGAATGATATTGAATTAGTA | 4268 |
| | TACTAATTCAATATCATTCTCAAATACTTACAGGAGTAAATGAG AGCTGGAAAAAGCGTTTCATTTCTCTCCTGAGCTGTTTCAACC AGCATACGAAGTGGACCTTTCGGACACAAAACAG | 4269 |
| | GAGAAATGAAACGCTTT | 4270 |
| | AAAGCGTTTCATTTCTC | 4271 |
| Alzheimer disease Leu282Arg CTT-CGT | TGTGTCCGAAAGGTCCACTTCGTATGCTGGTTGAAACAGCTC AGGAGAGAAATGAAACGCTTTTTCCAGCTCTCATTTACTCCTG TAAGTATTTGAGAATGATATTGAATTAGTAATCAGT | 4272 |
| | ACTGATTACTAATTCAATATCATTCTCAAATACTTACAGGAGTA AATGAGAGCTGGAAAAAGCGTTTCATTTCTCTCCTGAGCTGTT TCAACCAGCATACGAAGTGGACCTTTCGGACACA | 4273 |
| | TGAAACGCTTTTTCCAG | 4274 |
| | CTGGAAAAAGCGTTTCA | |
| Alzheimer disease ATa285Val GCT-GTT | AAGGTCCACTTCGTATGCTGGTTGAAACAGCTCAGGAGAGAA ATGAAACGCTTTTTCCAGCTCTCATTTACTCCTGTAAGTATTTG AGAATGATATTGAATTAGTAATCAGTGTAGAATTT | 4276 |
| | AAATTCTACACTGATTACTAATTCAATATCATTCTCAAATACTTA CAGGAGTAAATGAGAGCTGGAAAAAGCGTTTCATTTCTCTCCT GAGCTGTTTCAACCAGCATACGAAGTGGACCTT | 4277 |

TABLE 31-continued

PSEN1 Mutations and Genome-Correcting Oligos

| Clinical Phenotype & Mutation | Correcting Oligos | SEQ ID NO: |
|---|---|---|
| | TTTTCCAGCTCTCATTT | 4278 |
| | AAATGAGAGCTGGAAAA | 4279 |
| Alzheimer disease Leu286Val tCTC-GTC | GGTCCACTTCGTATGCTGGTTGAAACAGCTCAGGAGAGAAAT GAAACGCTTTTTCCAGCTCTCATTTACTCCTGTAAGTATTTGA GAATGATATTGAATTAGTAATCAGTGTAGAATTTAT | 4280 |
| | ATAAATTCTACACTGATTACTAATTCAATATCATTCTCAAATACT TACAGGAGTAAATGAGAGCTGGAAAAAGCGTTTCATTTCTCTC CTGAGCTGTTTCAACCAGCATACGAAGTGGACC | 4281 |
| | TTCCAGCTCTCATTTAC | 4282 |
| | GTAAATGAGAGCTGGAA | 4283 |
| Alzheimer disease Gly384Ala GGA-GCA | GTGACCAACTTTTTAATATTTGTAACCTTTCCTTTTTAGGGGGA GTAAAACTTGGATTGGGAGATTTCATTTTCTACAGTGTTCTGG TTGGTAAAGCCTCAGCAACAGCCAGTGGAGACTG | 4284 |
| | CAGTCTCCACTGGCTGTTGCTGAGGCTTTACCAACCAGAACA CTGTAGAAAATGAAATCTCCCAATCCAAGTTTTACTCCCCCTA AAAAGGAAAGGTTACAAATATTAAAAAGTTGGTCAC | 4285 |
| | TGGATTGGGAGATTTCA | 4286 |
| | TGAAATCTCCCAATCCA | 4287 |
| Alzheimer disease Ser390Ile AGT-ATT | TTTGTAACCTTTCCTTTTTAGGGGGAGTAAAACTTGGATTGGG AGATTTCATTTTCTACAGTGTTCTGGTTGGTAAAGCCTCAGCA ACAGCCAGTGGAGACTGGAACACAACCATAGCCTG | 4288 |
| | CAGGCTATGGTTGTGTTCCAGTCTCCACTGGCTGTTGCTGAG GCTTTACCAACCAGAACACTGTAGAAAATGAAATCTCCCAATC CAAGTTTTACTCCCCCTAAAAAGGAAAGGTTACAAA | 4289 |
| | TTTCTACAGTGTTCTGG | 4290 |
| | CCAGAACACTGTAGAAA | 4291 |
| Alzheimer disease Leu392Val tCTG-GTG | AACCTTTCCTTTTTAGGGGGAGTAAAACTTGGATTGGGAGATT TCATTTTCTACAGTGTTCTGGTTGGTAAAGCCTCAGCAACAGC CAGTGGAGACTGGAACACAACCATAGCCTGTTTCG | 4292 |
| | CGAAACAGGCTATGGTTGTGTTCCAGTCTCCACTGGCTGTTG CTGAGGCTTTACCAACCAGAACACTGTAGAAAATGAAATCTCC CAATCCAAGTTTTACTCCCCCTAAAAAGGAAAGGTT | 4293 |
| | ACAGTGTTCTGGTTGGT | 4294 |
| | ACCAACCAGAACACTGT | 4295 |
| Alzheimer disease Asn405Ser AAC-AGC | ATTTCATTTTCTACAGTGTTCTGGTTGGTAAAGCCTCAGCAAC AGCCAGTGGAGACTGGAACACAACCATAGCCTGTTTCGTAGC CATATTAATTGTAAGTATACACTAATAAGAATGTGT | 4296 |
| | ACACATTCTTATTAGTGTATACTTACAATTAATATGGCTACGAA ACAGGCTATGGTTGTGTTCCAGTCTCCACTGGCTGTTGCTGA GGCTTTACCAACCAGAACACTGTAGAAAATGAAAT | 4297 |
| | AGACTGGAACACAACCA | 4298 |
| | TGGTTGTGTTCCAGTCT | 4299 |
| Alzheimer disease Ala409Thr aGCC-ACC | TACAGTGTTCTGGTTGGTAAAGCCTCAGCAACAGCCAGTGGA GACTGGAACACAACCATAGCCTGTTTCGTAGCCATATTAATTG TAAGTATACACTAATAAGAATGTGTCAGAGCTCTTA | 4300 |
| | TAAGAGCTCTGACACATTCTTATTAGTGTATACTTACAATTAAT ATGGCTACGAAACAGGCTATGGTTGTGTTCCAGTCTCCACTG GCTGTTGCTGAGGCTTTACCAACCAGAACACTGTA | 4301 |
| | CAACCATAGCCTGTTTC | 4302 |
| | GAAACAGGCTATGGTTG | 4303 |

TABLE 31-continued

PSEN1 Mutations and Genome-Correcting Oligos

| Clinical Phenotype & Mutation | Correcting Oligos | SEQ ID NO: |
|---|---|---|
| Alzheimer disease Cys410Tyr TGT-TAT | GTGTTCTGGTTGGTAAAGCCTCAGCAACAGCCAGTGGAGACT GGAACACAACCATAGCCTGTTTCGTAGCCATATTAATTGTAAG TATACACTAATAAGAATGTGTCAGAGCTCTTAATGT | 4304 |
| | ACATTAAGAGCTCTGACACATTCTTATTAGTGTATACUACAAT TAATATGGCTACGAAACAGGCTATGGTTGTGTTCCAGTCTCCA CTGGCTGTTGCTGAGGCTTTACCAACCAGAACAC | 4305 |
| | CATAGCCTGTTTCGTAG | 4306 |
| | CTACGAAACAGGCTATG | 4307 |
| Alzheimer disease Ala426Pro tGCC-CCC | TGTGAATGTGTGTCTTTCCCATCTTCTCCACAGGGTTTGTGCC TTACATTATTACTCCTTGCCATTTTCAAGAAAGCATTGCCAGCT CTTCCAATCTCCATCACCTTTGGGCTTGTTTTCT | 4308 |
| | AGAAAACAAGCCCAAAGGTGATGGAGATTGGAAGAGCTGGCA ATGCTTTCTTGAAAATGGCAAGGAGTAATAATGTAAGGCACAA ACCCTGTGGAGAAGATGGGAAAGACACACATTCACA | 4309 |
| | TACTCCTTGCCATTTTC | 4310 |
| | GAAAATGGCAAGGAGTA | 4311 |
| Alzheimer disease Pro436Gln CCA-CAA | AGGGTTTGTGCCTTACATTATTACTCCTTGCCAVTTTCAAGAA AGCATTGCCAGCTCTTCCAATCTCCATCACCTTTGGGCTTGTT TTCTACTTTGCCACAGATTATCTTGTACAGCCTTT | 4312 |
| | AAAAGGCTGTACAAGATAATCTGTGGCAAAGTAGAAAACAAGC CCAAAGGTGATGGAGATTGGAAGAGCTGGCAATGCTTTCTTG AAAATGGCAAGGAGTAATAATGTAAGGCACAAACCCT | 4313 |
| | AGCTCTTCCAATCTCCA | 4314 |
| | TGGAGATTGGAAGAGCT | 4315 |
| Alzheimer disease Pro436Ser tCCA-TCA | CAGGGTTTGTGCCTTACATTATTACTCCTTGCCATTTTCAAGA AAGCATTGCCAGCTCTTCCAATCTCCATCACCTTTGGGCTTGT TTTCTACTTTGCCACAGATTATCTTGTACAGCCTT | 4316 |
| | AAGGCTGTACAAGATAATCTGTGGCAAAGTAGAAAACAAGCC CAAAGGTGATGGAGATTGGAAGAGCTGGCAATGCTTTCTTGA AAATGGCAAGGAGTAATAATGTAAGGCACAAACCCTG | 4317 |
| | CAGCTCTTCCAATCTCC | 4318 |
| | GGAGATTGGAAGAGCTG | 4319 |

EXAMPLE 25

Alzheimer's Disease—Presenilin-2 (PSEN2)

The attached table discloses the correcting oligonucleotide base sequences for the PSEN2 oligonucleotides of the invention.

TABLE 32

PSEN2 Mutations and Genome-Correcting Oligos

| ClinicaPhenotype & Mutation | Correcting Oligos | SEQ ID NO: |
|---|---|---|
| Alzheimer disease Arg62His CGC-CAC | GATGTGGTTTCCCACAGAGAAGCCAGGAGAACGAGGAGGAC GGTGAGGAGGACCCTGACCGCTATGTCTGTAGTGGGGTTCC CGGGCGGCCGCCAGGCCTGGAGGAAGAGCTGACCCTCAA | 4320 |
| | TTGAGGGTCAGCTCTTCCTCCAGGCCTGGCGGCCGCCCGGG AACCCCACTACAGACATAGCGGTCAGGGTCCTCCTCACCGTC | 4321 |

TABLE 32-continued

PSEN2 Mutations and Genome-Correcting Oligos

| ClinicaPhenotype & Mutation | Correcting Oligos | SEQ ID NO: |
|---|---|---|
| | CTCCTCGTTCTCCTGGCTTCTCTGTGGGAAACCACATC | |
| | CCCTGACCGCTATGTCT | 4322 |
| | AGACATAGCGGTCAGGG | 4323 |
| Alzheimer disease Thr122Pro cACG-CCG | GCCTCGAGGAGCAGTCAGGGCCGGGAGCATCAGCCCTTTGC CTTCTCCCTCAGCATCTACACGACATTCACTGAGGACACACC CTCGGTGGGCCAGCGCCTCCTCAACTCCGTGCTGAACA | 4324 |
| | TGTTCAGCACGGAGTTGAGGAGGCGCTGGCCCACCGAGGGT GTGTCCTCAGTGAATGTCGTGTAGATGCTGAGGGAGAAGGCA AAGGGCTGATGCTCCCGGCCCTGACTGCTCCTCGAGGC | 4325 |
| | GCATCTACACGACATTC | 4326 |
| | GAATGTCGTGTAGATGC | 4327 |
| Alzheimer disease Asn141Ile AAC-ATC | ACACGCCATTCACTGAGGACACACCCTCGGTGGGCCAGCGC CTCCTCAACTCCGTGCTGAACAGCCTCATCATGATCAGCGTC ATCGTGGTTATGACCATCTTCTTGGTGGTGCTCTACAA | 4328 |
| | TTGTAGAGCACCACCAAGAAGATGGTCATAACCACGATGACG CTGATCATGATGAGGGTGTTCAGCACGGAGTTGAGGAGGCG CTGGCCCACCGAGGGTGTGTCCTCAGTGAATGGCGTGT | 4329 |
| | CGTGCTGAACACCCTCA | 4330 |
| | TGAGGGTGTTCAGCACG | 4331 |
| Alzheimer disease Met239Ile ATGg-ATA | CCACTGGAAGGGCCCTCTGGTGCTGCAGCAGGCCTACCTCA TCATGATCAGTGCGCTCATGGCCCTAGTGTTCATCAAGTACCT CCCAGAGTGGTCCGCGTGGGTCATCCTGGGCGCCATC | 4332 |
| | GATGGCGCCCAGGATGACCCACGCGGACCACTCTGGGAGGT ACTTGATGAACACTAGGGCCATGAGCGCACTGATCATGATGA GGTAGGCCTGCTGCAGCACCAGAGGGCCCTTCCAGTGG | 4333 |
| | GCGCTCATGGCCCTAGT | 4334 |
| | ACTAGGGCCATGAGCGC | 4335 |
| Alzheimer disease Met239Val cATG-GTG | ATCCACTGGAAGGGCCCTCTGGTGCTGCAGCAGGCCTACCT CATCATGATCAGTGCGCTCATGGCCCTAGTGTTCATCAAGTA CCTCCCAGAGTGGTCCGCGTGGGTCATCCTGGGCGCCA | 4336 |
| | TGGCGCCCAGGATGACCCACGCGGACCACTCTGGGAGGTAC TTGATGAACACTAGGGCCATGAGCGCACTGATCATGATGAGG TAGGCCTGCTGCAGCACCAGAGGGCCCTTCCAGTGGAT | 4337 |
| | GTGCGCTCATGGCCCTA | 4338 |
| | TAGGGCCATGAGCGCAC | 4339 |

EXAMPLE 26

Plant Cells

The oligonucleotides of the invention can also be used to repair or direct a mutagenic event in plants and animal cells. Although little information is available on plant mutations amongst natural cultivars, the oligonucleotides of the invention can be used to produce "knock out" mutations by modification of specific amino acid codons to produce stop codons (e.g., a CAA codon specifying Gln can be modified at a specific site to TAA; a MG codon specifying Lys can be modified to UAG at a specific site; and a CGA codon for Arg can be modified to a UGA codon at a specific site). Such base pair changes will terminate the reading frame and produce a defective truncated protein, shortened at the site of the stop codon. Alternatively, frameshift additions or deletions can be directed into the genome at a specific sequence to interrupt the reading frame and produce a garbled downstream protein. Such stop or frameshift mutations can be introduced to determine the effect of knocking out the protein in either plant or animal cells.

All publications and patent applications cited in this specification are herein incorporated by reference as if each individual publication or patent application were specifically and individually indicated to be incorporated by reference. Although the foregoing invention has been described in some detail by way of illustration and example for purposes of clarity of understanding, it will be readily apparent to those of ordinary skill in the art in light of the teachings of

SEQUENCE LISTING (4385 sequences)

SEQ ID NO: 1 - DNA, 121 bp, Homo sapiens
agagacccaccgagcggcggcggagggagcagcgccggggcgcacgagggcaccatggcccagacgcccgccttcgacaagcccaaagtgagcgcgcgcgggggctccggggacgggggtc

SEQ ID NO: 2 - DNA, 121 bp, Homo sapiens
gacccccgtccccggagcccccgcgcgcgctcactttgggcttgtcgaaggcgggcgtctgggccatggtgccctcgtgcgccccggcgctgctccctccgccgccgctcggtgggtctct

SEQ ID NO: 3 - DNA, 17 bp, Homo sapiens
ccatggcccagacgccc

SEQ ID NO: 4 - DNA, 17 bp, Homo sapiens
gggcgtctgggccatgg

SEQ ID NO: 5 - DNA, 121 bp, Homo sapiens
tatttgttctctctctccctttctctctctcttccccctgcccccttgcaggtagaactgcatgtccacctagacggatccatcaagcctgaaaccatcttatactatggcaggtaagtcc

SEQ ID NO: 6 - DNA, 121 bp, Homo sapiens
ggacttacctgccatagtataagatggtttcaggcttgatggatccgtctaggtggacatgcagttctacctgcaagggggcagggggaagagagagagaaagggagagagagaacaaata

SEQ ID NO: 7 - DNA, 17 bp, Homo sapiens
tagaactgcatgtccac

SEQ ID NO: 8 - DNA, 17 bp, Homo sapiens
gtggacatgcagttcta

SEQ ID NO: 9 - DNA, 121 bp, Homo sapiens
tccctttctctctctcttccccctgcccccttgcaggtagaactgcatgtccacctagacggatccatcaagcctgaaaccatcttatactatggcaggtaagtccatacagaagagccct

SEQ ID NO: 10 - DNA, 121 bp, Homo sapiens
agggctcttctgtatggacttacctgccatagtataagatggtttcaggcttgatggatccgtctaggtggacatgcagttctacctgcaagggggcagggggaagagagagagaaaggga

SEQ ID NO: 11 - DNA, 17 bp, Homo sapiens
acctagacggatccatc

SEQ ID NO: 12 - DNA, 17 bp, Homo sapiens
gatggatccgtctaggt

SEQ ID NO: 13 - DNA, 121 bp, Homo sapiens
cctggagctcccaagggacttggggaaggttgttcccaacccctttcttcccttcccaggggctgccgggaggctatcaaaaggatcgcctatgagtttgtagagatgaaggccaaagagg

SEQ ID NO: 14 - DNA, 121 bp, Homo sapiens
cctctttggccttcatctctacaaactcataggcgatccttttgatagcctcccggcagcccctgggaagggaagaaaggggttgggaacaaccttccccaagtcccttgggagctccagg

SEQ ID NO: 15 - DNA, 17 bp, Homo sapiens
ctatcgcgggctgccgg

SEQ ID NO: 16 - DNA, 17 bp, Homo sapiens
ccggcagcccgcgatag

SEQ ID NO: 17 - DNA, 121 bp, Homo sapiens
gctcccaagggacttggggaaggttgttcccaacccctttcttcccttcccaggggctgccgggaggctatcaaaaggatcgcctatgagtttgtagagatgaaggccaaagagggcgtgg

SEQ ID NO: 18 - DNA, 121 bp, Homo sapiens
ccacgccctctttggccttcatctctacaaactcataggcgatccttttgatagcctcccggcagcccctgggaagggaagaaaggggttgggaacaaccttccccaagtcccttgggagc

SEQ ID NO: 19 - DNA, 17 bp, Homo sapiens
ggggctgccgggaggct

SEQ ID NO: 20 - DNA, 17 bp, Homo sapiens
agcctcccggcagcccc

SEQ ID NO: 21 - DNA, 121 bp, Homo sapiens
ttggggaaggttgttcccaacccctttcttcccttcccaggggctgccgggaggctatcaaaaggatcgcctatgagtttgtagagatgaaggccaaagagggcgtggtgtatgtggaggt

SEQ ID NO: 22 - DNA, 121 bp, Homo sapiens
acctccacatacaccacgccctctttggccttcatctctacaaactcataggcgatccttttgatagcctcccggcagcccctgggaagggaagaaaggggttgggaacaaccttccccaa

SEQ ID NO: 23 - DNA, 17 bp, Homo sapiens
ggctatcaaaaggatcg

SEQ ID NO: 24 - DNA, 17 bp, Homo sapiens
cgatccttttgatagcc

SEQ ID NO: 25 - DNA, 121 bp, Homo sapiens
gttgttcccaacccctttcttcccttcccaggggctgccgggaggctatcaaaaggatcgcctatgagtttgtagagatgaaggccaaagagggcgtggtgtatgtggaggtgcggtacag

SEQ ID NO: 26 - DNA, 121 bp, Homo sapiens
ctgtaccgcacctccacatacaccacgccctctttggccttcatctctacaaactcataggcgatccttttgatagcctcccggcagcccctgggaagggaagaaaggggttgggaacaac

SEQ ID NO: 27 - DNA, 17 bp, Homo sapiens
aaggatcgcctatgagt

SEQ ID NO: 28 - DNA, 17 bp, Homo sapiens
actcataggcgatcctt

SEQ ID NO: 29 - DNA, 121 bp, Homo sapiens
aggctatcaaaaggatcgcctatgagtttgtagagatgaaggccaaagagggcgtggtgtatgtggaggtgcggtacagtccgcacctgctggccaactccaaagtggagccaatcccctg

SEQ ID NO: 30 - DNA, 121 bp, Homo sapiens
caggggattggctccactttggagttggccagcaggtgcggactgtaccgcacctccacatacaccacgccctctttggccttcatctctacaaactcataggcgatccttttgatagcct

SEQ ID NO: 31 - DNA, 17 bp, Homo sapiens
cgtggtgtatgtggagg

SEQ ID NO: 32 - DNA, 17 bp, Homo sapiens
cctccacatacaccacg

SEQ ID NO: 33 - DNA, 121 bp, Homo sapiens
ggatcgcctatgagtttgtagagatgaaggccaaagagggcgtggtgtatgtggaggtgcggtacagtccgcacctgctggccaactccaaagtggagccaatcccctggaaccaggctga

SEQ ID NO: 34 - DNA, 121 bp, Homo sapiens
tcagcctggttccaggggattggctccactttggagttggccagcaggtgcggactgtaccgcacctccacatacaccacgccctctttggccttcatctctacaaactcataggcgatcc

SEQ ID NO: 35 - DNA, 17 bp, Homo sapiens
ggaggtgcggtacagtc

SEQ ID NO: 36 - DNA, 17 bp, Homo sapiens
gactgtaccgcacctcc

SEQ ID NO: 37 - DNA, 121 bp, Homo sapiens; identical to SEQ ID NO: 33

SEQ ID NO: 38 - DNA, 121 bp, Homo sapiens; identical to SEQ ID NO: 34

SEQ ID NO: 39 - DNA, 17 bp, Homo sapiens
ggaggtgcggtacagtc

SEQ ID NO: 40 - DNA, 17 bp, Homo sapiens
gactgtaccgcacctcc

SEQ ID NO: 41 - DNA, 121 bp, Homo sapiens
aggatcgcctatgagtttgtagagatgaaggccaaagagggcgtggtgtatgtggaggtgcggtacagtccgcacctgctggccaactccaaagtggagccaatcccctggaaccaggctg

SEQ ID NO: 42 - DNA, 121 bp, Homo sapiens
cagcctggttccaggggattggctccactttggagttggccagcaggtgcggactgtaccgcacctccacatacaccacgccctctttggccttcatctctacaaactcataggcgatcct

SEQ ID NO: 43 - DNA, 17 bp, Homo sapiens
tggaggtgcggtacagt

SEQ ID NO: 44 - DNA, 17 bp, Homo sapiens
actgtaccgcacctcca

SEQ ID NO: 45 - DNA, 121 bp, Homo sapiens
atgagtttgtagagatgaaggccaaagagggcgtggtgtatgtggaggtgcggtacagtccgcacctgctggccaactccaaagtggagccaatcccctggaaccaggctgagtgagtgat

SEQ ID NO: 46 - DNA, 121 bp, Homo sapiens
atcactcactcagcctggttccaggggattggctccactttggagttggccagcaggtgcggactgtaccgcacctccacatacaccacgccctctttggccttcatctctacaaactcat

SEQ ID NO: 47 - DNA, 17 bp, Homo sapiens
gtacagtccgcacctgc

SEQ ID NO: 48 - DNA, 17 bp, Homo sapiens
gcaggtgcggactgtac

SEQ ID NO: 49 - DNA, 121 bp, Homo sapiens
tttgtagagatgaaggccaaagagggcgtggtgtatgtggaggtgcggtacagtccgcacctgctggccaactccaaagtggagccaatcccctggaaccaggctgagtgagtgatgggcc

SEQ ID NO: 50 - DNA, 121 bp, Homo sapiens
ggcccatcactcactcagcctggttccaggggattggctccactttggagttggccagcaggtgcggactgtaccgcacctccacatacaccacgccctctttggccttcatctctacaaa

SEQ ID NO: 51 - DNA, 17 bp, Homo sapiens
gtccgcacctgctggcc

SEQ ID NO: 52 - DNA, 17 bp, Homo sapiens
ggccagcaggtgcggac

SEQ ID NO: 53 - DNA, 121 bp, Homo sapiens
tagagatgaaggccaaagagggcgtggtgtatgtggaggtgcggtacagtccgcacctgctggccaactccaaagtggagccaatcccctggaaccaggctgagtgagtgatgggcctgga

SEQ ID NO: 54 - DNA, 121 bp, Homo sapiens
tccaggcccatcactcactcagcctggttccaggggattggctccactttggagttggccagcaggtgcggactgtaccgcacctccacatacaccacgccctctttggccttcatctcta

SEQ ID NO: 55 - DNA, 17 bp, Homo sapiens
gcacctgctggccaact

SEQ ID NO: 56 - DNA, 17 bp, Homo sapiens
agttggccagcaggtgc

SEQ ID NO: 57 - DNA, 121 bp, Homo sapiens
gccttccttttgcctcaggcccatccctactcctctcctcacacagaggggacctcaccccagacgaggtggtggccctagtgggccagggcctgcaggagggggagcgagacttcggggt

SEQ ID NO: 58 - DNA, 121 bp, Homo sapiens
accccgaagtctcgctccccctcctgcaggccctggcccactagggccaccacctcgtctggggtgaggtcccctctgtgtgaggagaggagtagggatgggcctgaggcaaaaggaaggc

SEQ ID NO: 59 - DNA, 17 bp, Homo sapiens
cctcaccccagacgagg

SEQ ID NO: 60 - DNA, 17 bp, Homo sapiens
cctcgtctggggtgagg

SEQ ID NO: 61 - DNA, 121 bp, Homo sapiens
tttgcctcaggcccatccctactcctctcctcacacagaggggacctcaccccagacgaggtggtggccctagtgggccagggcctgcaggagggggagcgagacttcggggtcaaggccc

SEQ ID NO: 62 - DNA, 121 bp, Homo sapiens
gggccttgaccccgaagtctcgctccccctcctgcaggccctggcccactagggccaccacctcgtctggggtgaggtcccctctgtgtgaggagaggagtagggatgggcctgaggcaaa

SEQ ID NO: 63 - DNA, 17 bp, Homo sapiens
cagacgaggtggtggcc

SEQ ID NO: 64 - DNA, 17 bp, Homo sapiens
ggccaccacctcgtctg

SEQ ID NO: 65 - DNA, 121 bp, Homo sapiens
acagaggggacctcaccccagacgaggtggtggccctagtgggccagggcctgcaggagggggagcgagacttcggggtcaaggcccggtccatcctgtgctgcatgcgccaccagcccag

SEQ ID NO: 66 - DNA, 121 bp, Homo sapiens
ctgggctggtggcgcatgcagcacaggatggaccgggccttgaccccgaagtctcgctccccctcctgcaggccctggcccactagggccaccacctcgtctggggtgaggtcccctctgt

SEQ ID NO: 67 - DNA, 17 bp, Homo sapiens
gcaggagggggagcgag

SEQ ID NO: 68 - DNA, 17 bp, Homo sapiens
ctcgctccccctcctgc

SEQ ID NO: 69 - DNA, 121 bp, Homo sapiens
gggacctcaccccagacgaggtggtggccctagtgggccagggcctgcaggagggggagcgagacttcggggtcaaggcccggtccatcctgtgctgcatgcgccaccagcccagtgagta

SEQ ID NO: 70 - DNA, 121 bp, Homo sapiens
tactcactgggctggtggcgcatgcagcacaggatggaccgggccttgaccccgaagtctcgctccccctcctgcaggccctggcccactagggccaccacctcgtctggggtgaggtccc

SEQ ID NO: 71 - DNA, 17 bp, Homo sapiens
gggggagcgagacttcg

SEQ ID NO: 72 - DNA, 17 bp, Homo sapiens
cgaagtctcgctccccc

SEQ ID NO: 73 - DNA, 121 bp, Homo sapiens
ggggacctcaccccagacgaggtggtggccctagtgggccagggcctgcaggagggggagcgagacttcggggtcaaggcccggtccatcctgtgctgcatgcgccaccagcccagtgagt

SEQ ID NO: 74 - DNA, 121 bp, Homo sapiens
actcactgggctggtggcgcatgcagcacaggatggaccgggccttgaccccgaagtctcgctccccctcctgcaggccctggcccactagggccaccacctcgtctggggtgaggtcccc

SEQ ID NO: 75 - DNA, 17 bp, Homo sapiens
agggggagcgagacttc

SEQ ID NO: 76 - DNA, 17 bp, Homo sapiens
gaagtctcgctccccct

SEQ ID NO: 77 - DNA, 121 bp, Homo sapiens
tggtggccctagtgggccagggcctgcaggagggggagcgagacttcggggtcaaggcccggtccatcctgtgctgcatgcgccaccagcccagtgagtaggatcaccgccctgcccaggg

SEQ ID NO: 78 - DNA, 121 bp, Homo sapiens
ccctgggcagggcggtgatcctactcactgggctggtggcgcatgcagcacaggatggaccgggccttgaccccgaagtctcgctccccctcctgcaggccctggcccactagggccacca

SEQ ID NO: 79 - DNA, 17 bp, Homo sapiens
caaggcccggtccatcc

SEQ ID NO: 80 - DNA, 17 bp, Homo sapiens
ggatggaccgggccttg

SEQ ID NO: 81 - DNA, 121 bp, Homo sapiens
gtggtggccctagtgggccagggcctgcaggagggggagcgagacttcggggtcaaggcccggtccatcctgtgctgcatgcgccaccagcccagtgagtaggatcaccgccctgcccagg

SEQ ID NO: 82 - DNA, 121 bp, Homo sapiens
cctgggcagggcggtgatcctactcactgggctggtggcgcatgcagcacaggatggaccgggccttgaccccgaagtctcgctccccctcctgcaggccctggcccactagggccaccac

SEQ ID NO: 83 - DNA, 17 bp, Homo sapiens
tcaaggcccggtccatc

SEQ ID NO: 84 - DNA, 17 bp, Homo sapiens
gatggaccgggccttga

SEQ ID NO: 85 - DNA, 121 bp, Homo sapiens
ctagtgggccagggcctgcaggagggggagcgagacttcggggtcaaggcccggtccatcctgtgctgcatgcgccaccagcccagtgagtaggatcaccgccctgcccagggccgcccgt

SEQ ID NO: 86 - DNA, 121 bp, Homo sapiens
acgggcggccctgggcagggcggtgatcctactcactgggctggtggcgcatgcagcacaggatggaccgggccttgaccccgaagtctcgctccccctcctgcaggccctggcccactag

SEQ ID NO: 87 - DNA, 17 bp, Homo sapiens
ggtccatcctgtgctgc

SEQ ID NO: 88 - DNA, 17 bp, Homo sapiens
gcagcacaggatggacc

SEQ ID NO: 89 - DNA, 121 bp, Homo sapiens
ggcctgcaggagggggagcgagacttcggggtcaaggcccggtccatcctgtgctgcatgcgccaccagcccagtgagtaggatcaccgccctgcccagggccgcccgtctcaccctggcc

SEQ ID NO: 90 - DNA, 121 bp, Homo sapiens
ggccagggtgagacgggcggccctgggcagggcggtgatcctactcactgggctggtggcgcatgcagcacaggatggaccgggccttgaccccgaagtctcgctccccctcctgcaggcc

SEQ ID NO: 91 - DNA, 17 bp, Homo sapiens
gctgcatgcgccaccag

SEQ ID NO: 92 - DNA, 17 bp, Homo sapiens
ctggtggcgcatgcagc

SEQ ID NO: 93 - DNA, 121 bp, Homo sapiens
gcctgcaggagggggagcgagacttcggggtcaaggcccggtccatcctgtgctgcatgcgccaccagcccagtgagtaggatcaccgccctgcccagggccgcccgtctcaccctggccc

SEQ ID NO: 94 - DNA, 121 bp, Homo sapiens
gggccagggtgagacgggcggccctgggcagggcggtgatcctactcactgggctggtggcgcatgcagcacaggatggaccgggccttgaccccgaagtctcgctccccctcctgcaggc

SEQ ID NO: 95 - DNA, 17 bp, Homo sapiens
ctgcatgcgccaccagc

SEQ ID NO: 96 - DNA, 17 bp, Homo sapiens
gctggtggcgcatgcag

SEQ ID NO: 97 - DNA, 121 bp, Homo sapiens
ctgcccacagactggtcccccaaggtggtggagctgtgtaagaagtaccagcagcagaccgtggtagccattgacctggctggagatgagaccatcccaggaagcagcctcttgcctggac

SEQ ID NO: 98 - DNA, 121 bp, Homo sapiens
gtccaggcaagaggctgcttcctgggatggtctcatctccagccaggtcaatggctaccacggtctgctgctggtacttcttacacagctccaccaccttgggggaccagtctgtgggcag

SEQ ID NO: 99 - DNA, 17 bp, Homo sapiens
agcagaccgtggtagcc

SEQ ID NO: 100 - DNA, 17 bp, Homo sapiens
ggctaccacggtctgct

SEQ ID NO: 101 - DNA, 121 bp, Homo sapiens
cagactggtcccccaaggtggtggagctgtgtaagaagtaccagcagcagaccgtggtagccattgacctggctggagatgagaccatcccaggaagcagcctcttgcctggacatgtcca

SEQ ID NO: 102 - DNA, 121 bp, Homo sapiens
tggacatgtccaggcaagaggctgcttcctgggatggtctcatctccagccaggtcaatggctaccacggtctgctgctggtacttcttacacagctccaccaccttgggggaccagtctg

SEQ ID NO: 103 - DNA, 17 bp, Homo sapiens
cgtggtagccattgacc

SEQ ID NO: 104 - DNA, 17 bp, Homo sapiens
ggtcaatggctaccacg

SEQ ID NO: 105 - DNA, 121 bp, Homo sapiens
ccattgacctggctggagatgagaccatcccaggaagcagcctcttgcctggacatgtccaggcctaccaggtgggtcctgtgagaaggaatggagaggctggccctgggtgagcttgtct

SEQ ID NO: 106 - DNA, 121 bp, Homo sapiens
agacaagctcacccagggccagcctctccattccttctcacaggacccacctggtaggcctggacatgtccaggcaagaggctgcttcctgggatggtctcatctccagccaggtcaatgg

SEQ ID NO: 107 - DNA, 17 bp, Homo sapiens
acatgtccaggcctacc

SEQ ID NO: 108 - DNA, 17 bp, Homo sapiens
ggtaggcctggacatgt

SEQ ID NO: 109 - DNA, 121 bp, Homo sapiens
gctagggcacccatgacctggctctcccccttccaggaggctgtgaagagcggcattcaccgtactgtccacgccggggaggtgggctcggccgaagtagtaaaagaggtgagggcctggg

SEQ ID NO: 110 - DNA, 121 bp, Homo sapiens
cccaggccctcacctcttttactacttcggccgagcccacctccccggcgtggacagtacggtgaatgccgctcttcacagcctcctggaagggggagagccaggtcatgggtgccctagc

SEQ ID NO: 111 - DNA, 17 bp, Homo sapiens
gcattcaccgtactgtc

SEQ ID NO: 112 - DNA, 17 bp, Homo sapiens
gacagtacggtgaatgc

SEQ ID NO: 113 - DNA, 121 bp, Homo sapiens
ctagggcacccatgacctggctctcccccttccaggaggctgtgaagagcggcattcaccgtactgtccacgccggggaggtgggctcggccgaagtagtaaaagaggtgagggcctgggc

SEQ ID NO: 114 - DNA, 121 bp, Homo sapiens
gcccaggccctcacctcttttactacttcggccgagcccacctccccggcgtggacagtacggtgaatgccgctcttcacagcctcctggaagggggagagccaggtcatgggtgccctag

SEQ ID NO: 115 - DNA, 17 bp, Homo sapiens
cattcaccgtactgtcc

SEQ ID NO: 116 - DNA, 17 bp, Homo sapiens
ggacagtacggtgaatg

SEQ ID NO: 117 - DNA, 121 bp, Homo sapiens
atgacctggctctcccccttccaggaggctgtgaagagcggcattcaccgtactgtccacgccggggaggtgggctcggccgaagtagtaaaagaggtgagggcctgggctggccatgggg

SEQ ID NO: 118 - DNA, 121 bp, Homo sapiens
ccccatggccagcccaggccctcacctcttttactacttcggccgagcccacctccccggcgtggacagtacggtgaatgccgctcttcacagcctcctggaagggggagagccaggtcat

SEQ ID NO: 119 - DNA, 17 bp, Homo sapiens
ctgtccacgccggggag

SEQ ID NO: 120 - DNA, 17 bp, Homo sapiens
ctccccggcgtggacag

SEQ ID NO: 121 - DNA, 121 bp, Homo sapiens
acctggctctcccccttccaggaggctgtgaagagcggcattcaccgtactgtccacgccggggaggtgggctcggccgaagtagtaaaagaggtgagggcctgggctggccatggggtcc

SEQ ID NO: 122 - DNA, 121 bp, Homo sapiens
ggaccccatggccagcccaggccctcacctcttttactacttcggccgagcccacctccccggcgtggacagtacggtgaatgccgctcttcacagcctcctggaagggggagagccaggt

SEQ ID NO: 123 - DNA, 17 bp, Homo sapiens
tccacgccggggaggtg

SEQ ID NO: 124 - DNA, 17 bp, Homo sapiens
cacctccccggcgtgga

SEQ ID NO: 125 - DNA, 121 bp, Homo sapiens
tggctctcccccttccaggaggctgtgaagagcggcattcaccgtactgtccacgccggggaggtgggctcggccgaagtagtaaaagaggtgagggcctgggctggccatggggtccctc

SEQ ID NO: 126 - DNA, 121 bp, Homo sapiens
gagggaccccatggccagcccaggccctcacctcttttactacttcggccgagcccacctccccggcgtggacagtacggtgaatgccgctcttcacagcctcctggaagggggagagcca

SEQ ID NO: 127 - DNA, 17 bp, Homo sapiens
acgccggggaggtgggc

SEQ ID NO: 128 - DNA, 17 bp, Homo sapiens
gcccacctccccggcgt

SEQ ID NO: 129 - DNA, 121 bp, Homo sapiens
ctgcctcctcccatacttggctctattctgcttctctacaggctgtggacatactcaagacagagcggctgggacacggctaccacaccctggaagaccaggccctttataacaggctgcg

SEQ ID NO: 130 - DNA, 121 bp, Homo sapiens
cgcagcctgttataaagggcctggtcttccagggtgtggtagccgtgtcccagccgctctgtcttgagtatgtccacagcctgtagagaagcagaatagagccaagtatgggaggaggcag

SEQ ID NO: 131 - DNA, 17 bp, Homo sapiens
actcaagacagagcggc

SEQ ID NO: 132 - DNA, 17 bp, Homo sapiens
gccgctctgtcttgagt

SEQ ID NO: 133 - DNA, 121 bp, Homo sapiens
cagagcggctgggacacggctaccacaccctggaagaccaggccctttataacaggctgcggcaggaaaacatgcacttcgaggtaagcgggccagggagtggggaggaaccatccccggc

SEQ ID NO: 134 - DNA, 121 bp, Homo sapiens
gccggggatggttcctccccactccctggcccgcttacctcgaagtgcatgttttcctgccgcagcctgttataaagggcctggtcttccagggtgtggtagccgtgtcccagccgctctg

SEQ ID NO: 135 - DNA, 17 bp, Homo sapiens
caggctgcggcaggaaa

SEQ ID NO: 136 - DNA, 17 bp, Homo sapiens
tttcctgccgcagcctg

SEQ ID NO: 137 - DNA, 121 bp, Homo sapiens
gagcggctgggacacggctaccacaccctggaagaccaggccctttataacaggctgcggcaggaaaacatgcacttcgaggtaagcgggccagggagtggggaggaaccatccccggctg

SEQ ID NO: 138 - DNA, 121 bp, Homo sapiens
cagccggggatggttcctccccactccctggcccgcttacctcgaagtgcatgttttcctgccgcagcctgttataaagggcctggtcttccagggtgtggtagccgtgtcccagccgctc

SEQ ID NO: 139 - DNA, 17 bp, Homo sapiens
ggctgcggcaggaaaac

SEQ ID NO: 140 - DNA, 17 bp, Homo sapiens
gttttcctgccgcagcc

SEQ ID NO: 141 - DNA, 121 bp, Homo sapiens
ccacacacctgctcttccagatctgcccctggtccagctacctcactggtgcctggaagccggacacggagcatgcagtcattcggtgagctctgttcccctgggcctgttcaattttgtt

SEQ ID NO: 142 - DNA, 121 bp, Homo sapiens
aacaaaattgaacaggcccaggggaacagagctcaccgaatgactgcatgctccgtgtccggcttccaggcaccagtgaggtagctggaccaggggcagatctggaagagcaggtgtgtgg

SEQ ID NO: 143 - DNA, 17 bp, Homo sapiens
ctggaagccggacacgg

SEQ ID NO: 144 - DNA, 17 bp, Homo sapiens
ccgtgtccggcttccag

SEQ ID NO: 145 - DNA, 121 bp, Homo sapiens
ggaggctgattctctcctcctccctcttctgcaggctcaaaaatgaccaggctaactactcgctcaacacagatgacccgctcatcttcaagtccaccctggacactgattaccagatgac

SEQ ID NO: 146 - DNA, 121 bp, Homo sapiens
gtcatctggtaatcagtgtccagggtggacttgaagatgagcgggtcatctgtgttgagcgagtagttagcctggtcatttttgagcctgcagaagagggaggaggagagaatcagcctcc

SEQ ID NO: 147 - DNA, 17 bp, Homo sapiens
taactactcgctcaaca

SEQ ID NO: 148 - DNA, 17 bp, Homo sapiens
tgttgagcgagtagtta

SEQ ID NO: 149 - DNA, 121 bp, Homo sapiens
cctccctcttctgcaggctcaaaaatgaccaggctaactactcgctcaacacagatgacccgctcatcttcaagtccaccctggacactgattaccagatgaccaaacgggacatgggctt

SEQ ID NO: 150 - DNA, 121 bp, Homo sapiens
aagcccatgtcccgtttggtcatctggtaatcagtgtccagggtggacttgaagatgagcgggtcatctgtgttgagcgagtagttagcctggtcatttttgagcctgcagaagagggagg

SEQ ID NO: 151 - DNA, 17 bp, Homo sapiens
agatgacccgctcatct

SEQ ID NO: 152 - DNA, 17 bp, Homo sapiens
agatgagcgggtcatct

SEQ ID NO: 153 - DNA, 121 bp, Homo sapiens
aaaatgaccaggctaactactcgctcaacacagatgacccgctcatcttcaagtccaccctggacactgattaccagatgaccaaacgggacatgggctttactgaagaggagtttaaaag

SEQ ID NO: 154 - DNA, 121 bp, Homo sapiens
cttttaaactcctcttcagtaaagcccatgtcccgtttggtcatctggtaatcagtgtccagggtggacttgaagatgagcgggtcatctgtgttgagcgagtagttagcctggtcatttt

SEQ ID NO: 155 - DNA, 17 bp, Homo sapiens
gtccaccctggacactg

SEQ ID NO: 156 - DNA, 17 bp, Homo sapiens
cagtgtccagggtggac

SEQ ID NO: 157 - DNA, 121 bp, Homo sapiens
gccttctttgttctctggttccatgttgtctgccattctggcctttccagaacatcaatgcggccaaatctagtttcctcccagaagatgaaaagagggagcttctcgacctgctctataa

SEQ ID NO: 158 - DNA, 121 bp, Homo sapiens
ttatagagcaggtcgagaagctccctcttttcatcttctgggaggaaactagatttggccgcattgatgttctggaaaggccagaatggcagacaacatggaaccagagaacaaagaaggc

SEQ ID NO: 159 - DNA, 17 bp, Homo sapiens
catcaatgcggccaaat

SEQ ID NO: 160 - DNA, 17 bp, Homo sapiens
atttggccgcattgatg

SEQ ID NO: 161 - DNA, 121 bp, Homo sapiens
gactgtaccaccatccactacaactacatgtgtaacagttcctgcatgggcggcatgaaccggaggcccatcctcaccatcatcacactggaagactccaggtcaggagccacttgccacc

SEQ ID NO: 162 - DNA, 121 bp, Homo sapiens
ggtggcaagtggctcctgacctggagtcttccagtgtgatgatggtgaggatgggcctccggttcatgccgcccatgcaggaactgttacacatgtagttgtagtggatggtggtacagtc

SEQ ID NO: 163 - DNA, 17 bp, Homo sapiens
gcatgaaccggaggccc

SEQ ID NO: 164 - DNA, 17 bp, Homo sapiens
gggcctccggttcatgc

SEQ ID NO: 165 - DNA, 121 bp, Homo sapiens
tgtaacagttcctgcatgggcggcatgaaccggaggcccatcctcaccatcatcacactggaagactccaggtcaggagccacttgccaccctgcacactggcctgctgtgccccagcctc

SEQ ID NO: 166 - DNA, 121 bp, Homo sapiens
gaggctggggcacagcaggccagtgtgcagggtggcaagtggctcctgacctggagtcttccagtgtgatgatggtgaggatgggcctccggttcatgccgcccatgcaggaactgttaca

SEQ ID NO: 167 - DNA, 17 bp, Homo sapiens
tcacactggaagactcc

SEQ ID NO: 168 - DNA, 17 bp, Homo sapiens
ggagtcttccagtgtga

SEQ ID NO: 169 - DNA, 121 bp, Homo sapiens
gttggctctgactgtaccaccatccactacaactacatgtgtaacagttcctgcatgggcggcatgaaccggaggcccatcctcaccatcatcacactggaagactccaggtcaggagcca

SEQ ID NO: 170 - DNA, 121 bp, Homo sapiens
tggctcctgacctggagtcttccagtgtgatgatggtgaggatgggcctccggttcatgccgcccatgcaggaactgttacacatgtagttgtagtggatggtggtacagtcagagccaac

SEQ ID NO: 171 - DNA, 17 bp, Homo sapiens
gcatgggcggcatgaac

SEQ ID NO: 172 - DNA, 17 bp, Homo sapiens
gttcatgccgcccatgc

SEQ ID NO: 173 - DNA, 121 bp, Homo sapiens
tccactacaactacatgtgtaacagttcctgcatgggcggcatgaaccggaggcccatcctcaccatcatcacactggaagactccaggtcaggagccacttgccaccctgcacactggcc

SEQ ID NO: 174 - DNA, 121 bp, Homo sapiens
ggccagtgtgcagggtggcaagtggctcctgacctggagtcttccagtgtgatgatggtgaggatgggcctccggttcatgccgcccatgcaggaactgttacacatgtagttgtagtgga

SEQ ID NO: 175 - DNA, 17 bp, Homo sapiens
gcccatcctcaccatca

SEQ ID NO: 176 - DNA, 17 bp, Homo sapiens
tgatggtgaggatgggc

SEQ ID NO: 177 - DNA, 121 bp, Homo sapiens
taccaccatccactacaactacatgtgtaacagttcctgcatgggcggcatgaaccggaggcccatcctcaccatcatcacactggaagactccaggtcaggagccacttgccaccctgca

SEQ ID NO: 178 - DNA, 121 bp, Homo sapiens
tgcagggtggcaagtggctcctgacctggagtcttccagtgtgatgatggtgaggatgggcctccggttcatgccgcccatgcaggaactgttacacatgtagttgtagtggatggtggta

SEQ ID NO: 179 - DNA, 17 bp, Homo sapiens
aaccggaggcccatcct

SEQ ID NO: 180 - DNA, 17 bp, Homo sapiens
aggatgggcctccggtt

SEQ ID NO: 181 - DNA, 121 bp, Homo sapiens
ctggccaagacctgccctgtgcagctgtgggttgattccacacccccgcccggcacccgcgtccgcgccatggccatctacaagcagtcacagcacatgacggaggttgtgaggcgctgcc

SEQ ID NO: 182 - DNA, 121 bp, Homo sapiens
ggcagcgcctcacaacctccgtcatgtgctgtgactgcttgtagatggccatggcgcggacgcgggtgccgggcgggggtgtggaatcaacccacagctgcacagggcaggtcttggccag

SEQ ID NO: 183 - DNA, 17 bp, Homo sapiens
gcacccgcgtccgcgcc

SEQ ID NO: 184 - DNA, 17 bp, Homo sapiens
ggcgcggacgcgggtgc

SEQ ID NO: 185 - DNA, 121 bp, Homo sapiens
ttggctctgactgtaccaccatccactacaactacatgtgtaacagttcctgcatgggcggcatgaaccggaggcccatcctcaccatcatcacactggaagactccaggtcaggagccac

SEQ ID NO: 186 - DNA, 121 bp, Homo sapiens
gtggctcctgacctggagtcttccagtgtgatgatggtgaggatgggcctccggttcatgccgcccatgcaggaactgttacacatgtagttgtagtggatggtggtacagtcagagccaa

SEQ ID NO: 187 - DNA, 17 bp, Homo sapiens
catgggcggcatgaacc

SEQ ID NO: 188 - DNA, 17 bp, Homo sapiens
ggttcatgccgcccatg

SEQ ID NO: 189 - DNA, 121 bp, Homo sapiens
actgtaccaccatccactacaactacatgtgtaacagttcctgcatgggcggcatgaaccggaggcccatcctcaccatcatcacactggaagactccaggtcaggagccacttgccaccc

SEQ ID NO: 190 - DNA, 121 bp, Homo sapiens
gggtggcaagtggctcctgacctggagtcttccagtgtgatgatggtgaggatgggcctccggttcatgccgcccatgcaggaactgttacacatgtagttgtagtggatggtggtacagt

SEQ ID NO: 191 - DNA, 17 bp, Homo sapiens
catgaaccggaggccca

SEQ ID NO: 192 - DNA, 17 bp, Homo sapiens
tgggcctccggttcatg

SEQ ID NO: 193 - DNA, 121 bp, Homo sapiens
ccctgactttcaactctgtctccttcctcttcctacagtactcccctgccctcaacaagatgttttgccaactggccaagacctgccctgtgcagctgtgggttgattccacacccccgcc

SEQ ID NO: 194 - DNA, 121 bp, Homo sapiens
ggcgggggtgtggaatcaacccacagctgcacagggcaggtcttggccagttggcaaaacatcttgttgagggcaggggagtactgtaggaagaggaaggagacagagttgaaagtcaggg

SEQ ID NO: 195 - DNA, 17 bp, Homo sapiens
caacaagatgttttgcc

SEQ ID NO: 196 - DNA, 17 bp, Homo sapiens
ggcaaaacatcttgttg

SEQ ID NO: 197 - DNA, 121 bp, Homo sapiens
tcttgcttctcttttcctatcctgagtagtggtaatctactgggacggaacagctttgaggtgcgtgtttgtgcctgtcctgggagagaccggcgcacagaggaagagaatctccgcaaga

SEQ ID NO: 198 - DNA, 121 bp, Homo sapiens
tcttgcggagattctcttcctctgtgcgccggtctctcccaggacaggcacaaacacgcacctcaaagctgttccgtcccagtagattaccactactcaggataggaaaagagaagcaaga

SEQ ID NO: 199 - DNA, 17 bp, Homo sapiens
gctttgaggtgcgtgtt

SEQ ID NO: 200 - DNA, 17 bp, Homo sapiens
aacacgcacctcaaagc

SEQ ID NO: 201 - DNA, 121 bp, Homo sapiens
ttatctcctaggttggctctgactgtaccaccatccactacaactacatgtgtaacagttcctgcatgggcggcatgaaccggaggcccatcctcaccatcatcacactggaagactccag

SEQ ID NO: 202 - DNA, 121 bp, Homo sapiens
ctggagtcttccagtgtgatgatggtgaggatgggcctccggttcatgccgcccatgcaggaactgttacacatgtagttgtagtggatggtggtacagtcagagccaacctaggagataa

SEQ ID NO: 203 - DNA, 17 bp, Homo sapiens
taacagttcctgcatgg

SEQ ID NO: 204 - DNA, 17 bp, Homo sapiens
ccatgcaggaactgtta

SEQ ID NO: 205 - DNA, 121 bp, Homo sapiens
cagaaaacctaccagggcagctacggtttccgtctgggcttcttgcattctgggacagccaagtctgtgacttgcacggtcagttgccctgaggggctggcttccatgagacttcaatgcc

SEQ ID NO: 206 - DNA, 121 bp, Homo sapiens
ggcattgaagtctcatggaagccagcccctcagggcaactgaccgtgcaagtcacagacttggctgtcccagaatgcaagaagcccagacggaaaccgtagctgccctggtaggttttctg

SEQ ID NO: 207 - DNA, 17 bp, Homo sapiens
ggacagccaagtctgtg

SEQ ID NO: 208 - DNA, 17 bp, Homo sapiens
cacagacttggctgtcc

SEQ ID NO: 209 - DNA, 121 bp, Homo sapiens
ggtaatctactgggacggaacagctttgaggtgcgtgtttgtgcctgtcctgggagagaccggcgcacagaggaagagaatctccgcaagaaaggggagcctcaccacgagctgcccccag

SEQ ID NO: 210 - DNA, 121 bp, Homo sapiens
ctgggggcagctcgtggtgaggctcccctttcttgcggagattctcttcctctgtgcgccggtctctcccaggacaggcacaaacacgcacctcaaagctgttccgtcccagtagattacc

SEQ ID NO: 211 - DNA, 17 bp, Homo sapiens
ggagagaccggcgcaca

SEQ ID NO: 212 - DNA, 17 bp, Homo sapiens
tgtgcgccggtctctcc

SEQ ID NO: 213 - DNA, 121 bp, Homo sapiens
gcttctcttttcctatcctgagtagtggtaatctactgggacggaacagctttgaggtgcgtgtttgtgcctgtcctgggagagaccggcgcacagaggaagagaatctccgcaagaaagg

SEQ ID NO: 214 - DNA, 121 bp, Homo sapiens
cctttcttgcggagattctcttcctctgtgcgccggtctctcccaggacaggcacaaacacgcacctcaaagctgttccgtcccagtagattaccactactcaggataggaaaagagaagc

SEQ ID NO: 215 - DNA, 17 bp, Homo sapiens
tgaggtgcgtgtttgtg

SEQ ID NO: 216 - DNA, 17 bp, Homo sapiens
cacaaacacgcacctca

SEQ ID NO: 217 - DNA, 121 bp, Homo sapiens
tcctagcactgcccaacaacaccagctcctctccccagccaaagaagaaaccactggatggagaatatttcacccttcaggtactaagtcttgggacctcttatcaagtggaaagtttcca

SEQ ID NO: 218 - DNA, 121 bp, Homo sapiens
tggaaactttccacttgataagaggtcccaagacttagtacctgaagggtgaaatattctccatccagtggtttcttctttggctggggagaggagctggtgttgttgggcagtgctagga

SEQ ID NO: 219 - DNA, 17 bp, Homo sapiens
actggatggagaatatt

SEQ ID NO: 220 - DNA, 17 bp, Homo sapiens
aatattctccatccagt

SEQ ID NO: 221 - DNA, 121 bp, Homo sapiens
aatggttcactgaagacccaggtccagatgaagctcccagaatgccagaggctgctccccgcgtggcccctgcaccagcagctcctacaccggcggcccctgcaccagccccctcctggcc

SEQ ID NO: 222 - DNA, 121 bp, Homo sapiens
ggccaggagggggctggtgcaggggccgccggtgtaggagctgctggtgcaggggccacgcggggagcagcctctggcattctgggagcttcatctggacctgggtcttcagtgaaccatt

SEQ ID NO: 223 - DNA, 17 bp, Homo sapiens
tgctccccgcgtggccc

SEQ ID NO: 224 - DNA, 17 bp, Homo sapiens
gggccacgcggggagca

SEQ ID NO: 225 - DNA, 121 bp, Homo sapiens
aagctcccagaatgccagaggctgctccccgcgtggcccctgcaccagcagctcctacaccggcggcccctgcaccagccccctcctggcccctgtcatcttctgtcccttcccagaaaac

SEQ ID NO: 226 - DNA, 121 bp, Homo sapiens
gttttctgggaagggacagaagatgacaggggccaggagggggctggtgcaggggccgccggtgtaggagctgctggtgcaggggccacgcggggagcagcctctggcattctgggagctt

SEQ ID NO: 227 - DNA, 17 bp, Homo sapiens
tcctacaccggcggccc

SEQ ID NO: 228 - DNA, 17 bp, Homo sapiens
gggccgccggtgtagga

SEQ ID NO: 229 - DNA, 121 bp, Homo sapiens
ttcaactctgtctccttcctcttcctacagtactcccctgccctcaacaagatgttttgccaactggccaagacctgccctgtgcagctgtgggttgattccacacccccgcccggcaccc

SEQ ID NO: 230 - DNA, 121 bp, Homo sapiens
gggtgccgggcgggggtgtggaatcaacccacagctgcacagggcaggtcttggccagttggcaaaacatcttgttgagggcaggggagtactgtaggaagaggaaggagacagagttgaa

SEQ ID NO: 231 - DNA, 17 bp, Homo sapiens
tgttttgccaactggcc

SEQ ID NO: 232 - DNA, 17 bp, Homo sapiens
ggccagttggcaaaaca

SEQ ID NO: 233 - DNA, 121 bp, Homo sapiens
tcctcttcctacagtactcccctgccctcaacaagatgttttgccaactggccaagacctgccctgtgcagctgtgggttgattccacacccccgcccggcacccgcgtccgcgccatggc

SEQ ID NO: 234 - DNA, 121 bp, Homo sapiens
gccatggcgcggacgcgggtgccgggcgggggtgtggaatcaacccacagctgcacagggcaggtcttggccagttggcaaaacatcttgttgagggcaggggagtactgtaggaagagga

SEQ ID NO: 235 - DNA, 17 bp, Homo sapiens
caagacctgccctgtgc

SEQ ID NO: 236 - DNA, 17 bp, Homo sapiens
gcacagggcaggtcttg

SEQ ID NO: 237 - DNA, 121 bp, Homo sapiens
aacaagatgttttgccaactggccaagacctgccctgtgcagctgtgggttgattccacacccccgcccggcacccgcgtccgcgccatggccatctacaagcagtcacagcacatgacgg

SEQ ID NO: 238 - DNA, 121 bp, Homo sapiens
ccgtcatgtgctgtgactgcttgtagatggccatggcgcggacgcgggtgccgggcgggggtgtggaatcaacccacagctgcacagggcaggtcttggccagttggcaaaacatcttgtt

SEQ ID NO: 239 - DNA, 17 bp, Homo sapiens
attccacacccccgccc

SEQ ID NO: 240 - DNA, 17 bp, Homo sapiens
gggcgggggtgtggaat

SEQ ID NO: 241 - DNA, 121 bp, Homo sapiens
agatgttttgccaactggccaagacctgccctgtgcagctgtgggttgattccacacccccgcccggcacccgcgtccgcgccatggccatctacaagcagtcacagcacatgacggaggt

SEQ ID NO: 242 - DNA, 121 bp, Homo sapiens
acctccgtcatgtgctgtgactgcttgtagatggccatggcgcggacgcgggtgccgggcgggggtgtggaatcaacccacagctgcacagggcaggtcttggccagttggcaaaacatct

SEQ ID NO: 243 - DNA, 17 bp, Homo sapiens
cacacccccgcccggca

SEQ ID NO: 244 - DNA, 17 bp, Homo sapiens
tgccgggcgggggtgtg

SEQ ID NO: 245 - DNA, 121 bp, Homo sapiens
tttgccaactggccaagacctgccctgtgcagctgtgggttgattccacacccccgcccggcacccgcgtccgcgccatggccatctacaagcagtcacagcacatgacggaggttgtgag

SEQ ID NO: 246 - DNA, 121 bp, Homo sapiens
ctcacaacctccgtcatgtgctgtgactgcttgtagatggccatggcgcggacgcgggtgccgggcgggggtgtggaatcaacccacagctgcacagggcaggtcttggccagttggcaaa

SEQ ID NO: 247 - DNA, 17 bp, Homo sapiens
cccgcccggcacccgcg

SEQ ID NO: 248 - DNA, 17 bp, Homo sapiens
cgcgggtgccgggcggg

SEQ ID NO: 249 - DNA, 121 bp, Homo sapiens
cccgcgtccgcgccatggccatctacaagcagtcacagcacatgacggaggttgtgaggcgctgcccccaccatgagcgctgctcagatagcgatggtgagcagctggggctggagagacg

SEQ ID NO: 250 - DNA, 121 bp, Homo sapiens
cgtctctccagccccagctgctcaccatcgctatctgagcagcgctcatggtgggggcagcgcctcacaacctccgtcatgtgctgtgactgcttgtagatggccatggcgcggacgcggg

SEQ ID NO: 251 - DNA, 17 bp, Homo sapiens
tgtgaggcgctgccccc

SEQ ID NO: 252 - DNA, 17 bp, Homo sapiens
gggggcagcgcctcaca

SEQ ID NO: 253 - DNA, 121 bp, Homo sapiens
atggccatctacaagcagtcacagcacatgacggaggttgtgaggcgctgcccccaccatgagcgctgctcagatagcgatggtgagcagctggggctggagagacgacagggctggttgc

SEQ ID NO: 254 - DNA, 121 bp, Homo sapiens
gcaaccagccctgtcgtctctccagccccagctgctcaccatcgctatctgagcagcgctcatggtgggggcagcgcctcacaacctccgtcatgtgctgtgactgcttgtagatggccat

SEQ ID NO: 255 - DNA, 17 bp, Homo sapiens
cccaccatgagcgctgc

SEQ ID NO: 256 - DNA, 17 bp, Homo sapiens
gcagcgctcatggtggg

SEQ ID NO: 257 - DNA, 121 bp, Homo sapiens
gccatctacaagcagtcacagcacatgacggaggttgtgaggcgctgcccccaccatgagcgctgctcagatagcgatggtgagcagctggggctggagagacgacagggctggttgccca

SEQ ID NO: 258 - DNA, 121 bp, Homo sapiens
tgggcaaccagccctgtcgtctctccagccccagctgctcaccatcgctatctgagcagcgctcatggtgggggcagcgcctcacaacctccgtcatgtgctgtgactgcttgtagatggc

SEQ ID NO: 259 - DNA, 17 bp, Homo sapiens
accatgagcgctgctca

SEQ ID NO: 260 - DNA, 17 bp, Homo sapiens
tgagcagcgctcatggt

SEQ ID NO: 261 - DNA, 121 bp, Homo sapiens
ccatctacaagcagtcacagcacatgacggaggttgtgaggcgctgcccccaccatgagcgctgctcagatagcgatggtgagcagctggggctggagagacgacagggctggttgcccag

SEQ ID NO: 262 - DNA, 121 bp, Homo sapiens
ctgggcaaccagccctgtcgtctctccagccccagctgctcaccatcgctatctgagcagcgctcatggtgggggcagcgcctcacaacctccgtcatgtgctgtgactgcttgtagatgg

SEQ ID NO: 263 - DNA, 17 bp, Homo sapiens
ccatgagcgctgctcag

SEQ ID NO: 264 - DNA, 17 bp, Homo sapiens
ctgagcagcgctcatgg

SEQ ID NO: 265 - DNA, 121 bp, Homo sapiens
ccagggtccccaggcctctgattcctcactgattgctcttaggtctggcccctcctcagcatcttatccgagtggaaggaaatttgcgtgtggagtatttggatgacagaaacacttttcg

SEQ ID NO: 266 - DNA, 121 bp, Homo sapiens
cgaaaagtgtttctgtcatccaaatactccacacgcaaatttccttccactcggataagatgctgaggaggggccagacctaagagcaatcagtgaggaatcagaggcctggggaccctgg

SEQ ID NO: 267 - DNA, 17 bp, Homo sapiens
tcctcagcatcttatcc

SEQ ID NO: 268 - DNA, 17 bp, Homo sapiens
ggataagatgctgagga

SEQ ID NO: 269 - DNA, 121 bp, Homo sapiens
cccaggcctctgattcctcactgattgctcttaggtctggcccctcctcagcatcttatccgagtggaaggaaatttgcgtgtggagtatttggatgacagaaacacttttcgacatagtg

SEQ ID NO: 270 - DNA, 121 bp, Homo sapiens
cactatgtcgaaaagtgtttctgtcatccaaatactccacacgcaaatttccttccactcggataagatgctgaggaggggccagacctaagagcaatcagtgaggaatcagaggcctggg

SEQ ID NO: 271 - DNA, 17 bp, Homo sapiens
atcttatccgagtggaa

SEQ ID NO: 272 - DNA, 17 bp, Homo sapiens
ttccactcggataagat

SEQ ID NO: 273 - DNA, 121 bp, Homo sapiens
gcccctcctcagcatcttatccgagtggaaggaaatttgcgtgtggagtatttggatgacagaaacacttttcgacatagtgtggtggtgccctatgagccgcctgaggtctggtttgcaa

SEQ ID NO: 274 - DNA, 121 bp, Homo sapiens
ttgcaaaccagacctcaggcggctcatagggcaccaccacactatgtcgaaaagtgtttctgtcatccaaatactccacacgcaaatttccttccactcggataagatgctgaggaggggc

SEQ ID NO: 275 - DNA, 17 bp, Homo sapiens
tggatgacagaaacact

SEQ ID NO: 276 - DNA, 17 bp, Homo sapiens
agtgtttctgtcatcca

SEQ ID NO: 277 - DNA, 121 bp, Homo sapiens
catcttatccgagtggaaggaaatttgcgtgtggagtatttggatgacagaaacacttttcgacatagtgtggtggtgccctatgagccgcctgaggtctggtttgcaactggggtctctg

SEQ ID NO: 278 - DNA, 121 bp, Homo sapiens
cagagaccccagttgcaaaccagacctcaggcggctcatagggcaccaccacactatgtcgaaaagtgtttctgtcatccaaatactccacacgcaaatttccttccactcggataagatg

SEQ ID NO: 279 - DNA, 17 bp, Homo sapiens
acacttttcgacatagt

SEQ ID NO: 280 - DNA, 17 bp, Homo sapiens
actatgtcgaaaagtgt

SEQ ID NO: 281 - DNA, 121 bp, Homo sapiens
ggaaatttgcgtgtggagtatttggatgacagaaacacttttcgacatagtgtggtggtgccctatgagccgcctgaggtctggtttgcaactggggtctctgggaggaggggttaagggt

SEQ ID NO: 282 - DNA, 121 bp, Homo sapiens
acccttaacccctcctcccagagaccccagttgcaaaccagacctcaggcggctcatagggcaccaccacactatgtcgaaaagtgtttctgtcatccaaatactccacacgcaaatttcc

SEQ ID NO: 283 - DNA, 17 bp, Homo sapiens
tggtggtgccctatgag

SEQ ID NO: 284 - DNA, 17 bp, Homo sapiens
ctcatagggcaccacca

SEQ ID NO: 285 - DNA, 121 bp, Homo sapiens
atttgcgtgtggagtatttggatgacagaaacacttttcgacatagtgtggtggtgccctatgagccgcctgaggtctggtttgcaactggggtctctgggaggaggggttaagggtggtt

SEQ ID NO: 286 - DNA, 121 bp, Homo sapiens
aaccacccttaacccctcctcccagagaccccagttgcaaaccagacctcaggcggctcatagggcaccaccacactatgtcgaaaagtgtttctgtcatccaaatactccacacgcaaat

SEQ ID NO: 287 - DNA, 17 bp, Homo sapiens
ggtgccctatgagccgc

SEQ ID NO: 288 - DNA, 17 bp, Homo sapiens
gcggctcatagggcacc

SEQ ID NO: 289 - DNA, 121 bp, Homo sapiens
cacaggtctccccaaggcgcactggcctcatcttgggcctgtgttatctcctaggttggctctgactgtaccaccatccactacaactacatgtgtaacagttcctgcatgggcggcatga

SEQ ID NO: 290 - DNA, 121 bp, Homo sapiens
tcatgccgcccatgcaggaactgttacacatgtagttgtagtggatggtggtacagtcagagccaacctaggagataacacaggcccaagatgaggccagtgcgccttggggagacctgtg

SEQ ID NO: 291 - DNA, 17 bp, Homo sapiens
aggttggctctgactgt

SEQ ID NO: 292 - DNA, 17 bp, Homo sapiens
acagtcagagccaacct

SEQ ID NO: 293 - DNA, 121 bp, Homo sapiens
gcactggcctcatcttgggcctgtgttatctcctaggttggctctgactgtaccaccatccactacaactacatgtgtaacagttcctgcatgggcggcatgaaccggaggcccatcctca

SEQ ID NO: 294 - DNA, 121 bp, Homo sapiens
tgaggatgggcctccggttcatgccgcccatgcaggaactgttacacatgtagttgtagtggatggtggtacagtcagagccaacctaggagataacacaggcccaagatgaggccagtgc

SEQ ID NO: 295 - DNA, 17 bp, Homo sapiens
ccaccatccactacaac

SEQ ID NO: 296 - DNA, 17 bp, Homo sapiens
gttgtagtggatggtgg

SEQ ID NO: 297 - DNA, 121 bp, Homo sapiens
gcctcatcttgggcctgtgttatctcctaggttggctctgactgtaccaccatccactacaactacatgtgtaacagttcctgcatgggcggcatgaaccggaggcccatcctcaccatca

SEQ ID NO: 298 - DNA, 121 bp, Homo sapiens
tgatggtgaggatgggcctccggttcatgccgcccatgcaggaactgttacacatgtagttgtagtggatggtggtacagtcagagccaacctaggagataacacaggcccaagatgaggc

SEQ ID NO: 299 - DNA, 17 bp, Homo sapiens
tccactacaactacatg

SEQ ID NO: 300 - DNA, 17 bp, Homo sapiens
catgtagttgtagtgga

SEQ ID NO: 301 - DNA, 121 bp, Homo sapiens
cctcatcttgggcctgtgttatctcctaggttggctctgactgtaccaccatccactacaactacatgtgtaacagttcctgcatgggcggcatgaaccggaggcccatcctcaccatcat

SEQ ID NO: 302 - DNA, 121 bp, Homo sapiens
atgatggtgaggatgggcctccggttcatgccgcccatgcaggaactgttacacatgtagttgtagtggatggtggtacagtcagagccaacctaggagataacacaggcccaagatgagg

SEQ ID NO: 303 - DNA, 17 bp, Homo sapiens
ccactacaactacatgt

SEQ ID NO: 304 - DNA, 17 bp, Homo sapiens
acatgtagttgtagtgg

SEQ ID NO: 305 - DNA, 121 bp, Homo sapiens
catccactacaactacatgtgtaacagttcctgcatgggcggcatgaaccggaggcccatcctcaccatcatcacactggaagactccaggtcaggagccacttgccaccctgcacactgg

SEQ ID NO: 306 - DNA, 121 bp, Homo sapiens
ccagtgtgcagggtggcaagtggctcctgacctggagtcttccagtgtgatgatggtgaggatgggcctccggttcatgccgcccatgcaggaactgttacacatgtagttgtagtggatg

SEQ ID NO: 307 - DNA, 17 bp, Homo sapiens
aggcccatcctcaccat

SEQ ID NO: 308 - DNA, 17 bp, Homo sapiens
atggtgaggatgggcct

SEQ ID NO: 309 - DNA, 121 bp, Homo sapiens
acatgtgtaacagttcctgcatgggcggcatgaaccggaggcccatcctcaccatcatcacactggaagactccaggtcaggagccacttgccaccctgcacactggcctgctgtgcccca

SEQ ID NO: 310 - DNA, 121 bp, Homo sapiens
tggggcacagcaggccagtgtgcagggtggcaagtggctcctgacctggagtcttccagtgtgatgatggtgaggatgggcctccggttcatgccgcccatgcaggaactgttacacatgt

SEQ ID NO: 311 - DNA, 17 bp, Homo sapiens
catcatcacactggaag

SEQ ID NO: 312 - DNA, 17 bp, Homo sapiens
cttccagtgtgatgatg

SEQ ID NO: 313 - DNA, 121 bp, Homo sapiens
tgtgtaacagttcctgcatgggcggcatgaaccggaggcccatcctcaccatcatcacactggaagactccaggtcaggagccacttgccaccctgcacactggcctgctgtgccccagcc

SEQ ID NO: 314 - DNA, 121 bp, Homo sapiens
ggctggggcacagcaggccagtgtgcagggtggcaagtggctcctgacctggagtcttccagtgtgatgatggtgaggatgggcctccggttcatgccgcccatgcaggaactgttacaca

SEQ ID NO: 315 - DNA, 17 bp, Homo sapiens
catcacactggaagact

SEQ ID NO: 316 - DNA, 17 bp, Homo sapiens
agtcttccagtgtgatg

SEQ ID NO: 317 - DNA, 121 bp, Homo sapiens
gacctgatttccttactgcctcttgcttctcttttcctatcctgagtagtggtaatctactgggacggaacagctttgaggtgcgtgtttgtgcctgtcctgggagagaccggcgcacaga

SEQ ID NO: 318 - DNA, 121 bp, Homo sapiens
tctgtgcgccggtctctcccaggacaggcacaaacacgcacctcaaagctgttccgtcccagtagattaccactactcaggataggaaaagagaagcaagaggcagtaaggaaatcaggtc

SEQ ID NO: 319 - DNA, 17 bp, Homo sapiens
taatctactgggacgga

SEQ ID NO: 320 - DNA, 17 bp, Homo sapiens
tccgtcccagtagatta

SEQ ID NO: 321 - DNA, 121 bp, Homo sapiens
tgcttctcttttcctatcctgagtagtggtaatctactgggacggaacagctttgaggtgcgtgtttgtgcctgtcctgggagagaccggcgcacagaggaagagaatctccgcaagaaag

SEQ ID NO: 322 - DNA, 121 bp, Homo sapiens
ctttcttgcggagattctcttcctctgtgcgccggtctctcccaggacaggcacaaacacgcacctcaaagctgttccgtcccagtagattaccactactcaggataggaaaagagaagca

SEQ ID NO: 323 - DNA, 17 bp, Homo sapiens
ttgaggtgcgtgtttgt

SEQ ID NO: 324 - DNA, 17 bp, Homo sapiens
acaaacacgcacctcaa

SEQ ID NO: 325 - DNA, 121 bp, Homo sapiens
cttttcctatcctgagtagtggtaatctactgggacggaacagctttgaggtgcgtgtttgtgcctgtcctgggagagaccggcgcacagaggaagagaatctccgcaagaaaggggagcc

SEQ ID NO: 326 - DNA, 121 bp, Homo sapiens
ggctcccctttcttgcggagattctcttcctctgtgcgccggtctctcccaggacaggcacaaacacgcacctcaaagctgttccgtcccagtagattaccactactcaggataggaaaag

SEQ ID NO: 327 - DNA, 17 bp, Homo sapiens
gcgtgtttgtgcctgtc

SEQ ID NO: 328 - DNA, 17 bp, Homo sapiens
gacaggcacaaacacgc

SEQ ID NO: 329 - DNA, 121 bp, Homo sapiens
tcctgagtagtggtaatctactgggacggaacagctttgaggtgcgtgtttgtgcctgtcctgggagagaccggcgcacagaggaagagaatctccgcaagaaaggggagcctcaccacga

SEQ ID NO: 330 - DNA, 121 bp, Homo sapiens
tcgtggtgaggctcccctttcttgcggagattctcttcctctgtgcgccggtctctcccaggacaggcacaaacacgcacctcaaagctgttccgtcccagtagattaccactactcagga

SEQ ID NO: 331 - DNA, 17 bp, Homo sapiens
tgcctgtcctgggagag

SEQ ID NO: 332 - DNA, 17 bp, Homo sapiens
ctctcccaggacaggca

SEQ ID NO: 333 - DNA, 121 bp, Homo sapiens
gtagtggtaatctactgggacggaacagctttgaggtgcgtgtttgtgcctgtcctgggagagaccggcgcacagaggaagagaatctccgcaagaaaggggagcctcaccacgagctgcc

SEQ ID NO: 334 - DNA, 121 bp, Homo sapiens
ggcagctcgtggtgaggctcccctttcttgcggagattctcttcctctgtgcgccggtctctcccaggacaggcacaaacacgcacctcaaagctgttccgtcccagtagattaccactac

SEQ ID NO: 335 - DNA, 17 bp, Homo sapiens
tcctgggagagaccggc

SEQ ID NO: 336 - DNA, 17 bp, Homo sapiens
gccggtctctcccagga

SEQ ID NO: 337 - DNA, 121 bp, Homo sapiens
ggaacagctttgaggtgcgtgtttgtgcctgtcctgggagagaccggcgcacagaggaagagaatctccgcaagaaaggggagcctcaccacgagctgcccccagggagcactaagcgagg

SEQ ID NO: 338 - DNA, 121 bp, Homo sapiens
cctcgcttagtgctccctgggggcagctcgtggtgaggctcccctttcttgcggagattctcttcctctgtgcgccggtctctcccaggacaggcacaaacacgcacctcaaagctgttcc

SEQ ID NO: 339 - DNA, 17 bp, Homo sapiens
agaggaagagaatctcc

SEQ ID NO: 340 - DNA, 17 bp, Homo sapiens
ggagattctcttcctct

SEQ ID NO: 341 - DNA, 121 bp, Homo sapiens
aagagaatctccgcaagaaaggggagcctcaccacgagctgcccccagggagcactaagcgaggtaagcaagcaggacaagaagcggtggaggagaccaagggtgcagttatgcctcagat

SEQ ID NO: 342 - DNA, 121 bp, Homo sapiens
atctgaggcataactgcacccttggtctcctccaccgcttcttgtcctgcttgcttacctcgcttagtgctccctgggggcagctcgtggtgaggctcccctttcttgcggagattctctt

SEQ ID NO: 343 - DNA, 17 bp, Homo sapiens
cactaagcgaggtaagc

SEQ ID NO: 344 - DNA, 17 bp, Homo sapiens
gcttacctcgcttagtg

SEQ ID NO: 345 - DNA, 121 bp, Homo sapiens
gaagagaatctccgcaagaaaggggagcctcaccacgagctgcccccagggagcactaagcgaggtaagcaagcaggacaagaagcggtggaggagaccaagggtgcagttatgcctcaga

SEQ ID NO: 346 - DNA, 121 bp, Homo sapiens
tctgaggcataactgcacccttggtctcctccaccgcttcttgtcctgcttgcttacctcgcttagtgctccctgggggcagctcgtggtgaggctcccctttcttgcggagattctcttc

SEQ ID NO: 347 - DNA, 17 bp, Homo sapiens
gcactaagcgaggtaag

SEQ ID NO: 348 - DNA, 17 bp, Homo sapiens
cttacctcgcttagtgc

SEQ ID NO: 349 - DNA, 121 bp, Homo sapiens
ggtactgtgaatatacttacttctccccctcctctgttgctgcagatccgtgggcgtgagcgcttcgagatgttccgagagctgaatgaggccttggaactcaaggatgcccaggctggga

SEQ ID NO: 350 - DNA, 121 bp, Homo sapiens
tcccagcctgggcatccttgagttccaaggcctcattcagctctcggaacatctcgaagcgctcacgcccacggatctgcagcaacagaggagggggagaagtaagtatattcacagtacc

SEQ ID NO: 351 - DNA, 17 bp, Homo sapiens
ggcgtgagcgcttcgag

SEQ ID NO: 352 - DNA, 17 bp, Homo sapiens
ctcgaagcgctcacgcc

SEQ ID NO: 353 - DNA, 121 bp, Homo sapiens
ctccccctcctctgttgctgcagatccgtgggcgtgagcgcttcgagatgttccgagagctgaatgaggccttggaactcaaggatgcccaggctgggaaggagccaggggggagcagggc

SEQ ID NO: 354 - DNA, 121 bp, Homo sapiens
gccctgctcccccctggctccttcccagcctgggcatccttgagttccaaggcctcattcagctctcggaacatctcgaagcgctcacgcccacggatctgcagcaacagaggagggggag

SEQ ID NO: 355 - DNA, 17 bp, Homo sapiens
ccgagagctgaatgagg

SEQ ID NO: 356 - DNA, 17 bp, Homo sapiens
cctcattcagctctcgg

SEQ ID NO: 357 - DNA, 121 bp, Homo sapiens
tctgacacaactgtgttcactagcaacctcaaacagacaccatggtgcacctgactcctgaggagaagtctgccgttactgccctgtggggcaaggtgaacgtggatgaagttggtggtga

SEQ ID NO: 358 - DNA, 121 bp, Homo sapiens
tcaccaccaacttcatccacgttcaccttgccccacagggcagtaacggcagacttctcctcaggagtcaggtgcaccatggtgtctgtttgaggttgctagtgaacacagttgtgtcaga

SEQ ID NO: 359 - DNA, 17 bp, Homo sapiens
gactcctgaggagaagt

SEQ ID NO: 360 - DNA, 17 bp, Homo sapiens
acttctcctcaggagtc

SEQ ID NO: 361 - DNA, 121 bp, Homo sapiens
ctattgcttacatttgcttctgacacaactgtgttcactagcaacctcaaacagacaccatggtgcacctgactcctgaggagaagtctgccgttactgccctgtggggcaaggtgaacgt

SEQ ID NO: 362 - DNA, 121 bp, Homo sapiens
acgttcaccttgccccacagggcagtaacggcagacttctcctcaggagtcaggtgcaccatggtgtctgtttgaggttgctagtgaacacagttgtgtcagaagcaaatgtaagcaatag

SEQ ID NO: 363 - DNA, 17 bp, Homo sapiens
agacaccatggtgcacc

SEQ ID NO: 364 - DNA, 17 bp, Homo sapiens
ggtgcaccatggtgtct

SEQ ID NO: 365 - DNA, 121 bp, Homo sapiens
tattgcttacatttgcttctgacacaactgtgttcactagcaacctcaaacagacaccatggtgcacctgactcctgaggagaagtctgccgttactgccctgtggggcaaggtgaacgtg

SEQ ID NO: 366 - DNA, 121 bp, Homo sapiens
cacgttcaccttgccccacagggcagtaacggcagacttctcctcaggagtcaggtgcaccatggtgtctgtttgaggttgctagtgaacacagttgtgtcagaagcaaatgtaagcaata

SEQ ID NO: 367 - DNA, 17 bp, Homo sapiens
gacaccatggtgcacct

SEQ ID NO: 368 - DNA, 17 bp, Homo sapiens
aggtgcaccatggtgtc

SEQ ID NO: 369 - DNA, 121 bp, Homo sapiens; identical to SEQ ID NO: 365

SEQ ID NO: 370 - DNA, 121 bp, Homo sapiens; identical to SEQ ID NO: 366

SEQ ID NO: 371 - DNA, 17 bp, Homo sapiens
gacaccatggtgcacct

SEQ ID NO: 372 - DNA, 17 bp, Homo sapiens
aggtgcaccatggtgtc

SEQ ID NO: 373 - DNA, 121 bp, Homo sapiens; identical to SEQ ID NO: 361

SEQ ID NO: 374 - DNA, 121 bp, Homo sapiens; identical to SEQ ID NO: 362

SEQ ID NO: 375 - DNA, 17 bp, Homo sapiens
agacaccatggtgcacc

SEQ ID NO: 376 - DNA, 17 bp, Homo sapiens
ggtgcaccatggtgtct

SEQ ID NO: 377 - DNA, 121 bp, Homo sapiens; identical to SEQ ID NO: 361

SEQ ID NO: 378 - DNA, 121 bp, Homo sapiens; identical to SEQ ID NO: 362

SEQ ID NO: 379 - DNA, 17 bp, Homo sapiens
agacaccatggtgcacc

SEQ ID NO: 380 - DNA, 17 bp, Homo sapiens
ggtgcaccatggtgtct

SEQ ID NO: 381 - DNA, 121 bp, Homo sapiens
tctattgcttacatttgcttctgacacaactgtgttcactagcaacctcaaacagacaccatggtgcacctgactcctgaggagaagtctgccgttactgccctgtggggcaaggtgaacg

SEQ ID NO: 382 - DNA, 121 bp, Homo sapiens
cgttcaccttgccccacagggcagtaacggcagacttctcctcaggagtcaggtgcaccatggtgtctgtttgaggttgctagtgaacacagttgtgtcagaagcaaatgtaagcaataga

SEQ ID NO: 383 - DNA, 17 bp, Homo sapiens
cagacaccatggtgcac

SEQ ID NO: 384 - DNA, 17 bp, Homo sapiens
gtgcaccatggtgtctg

SEQ ID NO: 385 - DNA, 121 bp, Homo sapiens
tcaaacagacaccatggtgcacctgactcctgaggagaagtctgccgttactgccctgtggggcaaggtgaacgtggatgaagttggtggtgaggccctgggcaggttggtatcaaggtta

SEQ ID NO: 386 - DNA, 121 bp, Homo sapiens
taaccttgataccaacctgcccagggcctcaccaccaacttcatccacgttcaccttgccccacagggcagtaacggcagacttctcctcaggagtcaggtgcaccatggtgtctgtttga

SEQ ID NO: 387 - DNA, 17 bp, Homo sapiens
gccctgtggggcaaggt

SEQ ID NO: 388 - DNA, 17 bp, Homo sapiens
accttgccccacagggc

SEQ ID NO: 389 - DNA, 121 bp, Homo sapiens
ctcaaacagacaccatggtgcacctgactcctgaggagaagtctgccgttactgccctgtggggcaaggtgaacgtggatgaagttggtggtgaggccctgggcaggttggtatcaaggtt

SEQ ID NO: 390 - DNA, 121 bp, Homo sapiens
aaccttgataccaacctgcccagggcctcaccaccaacttcatccacgttcaccttgccccacagggcagtaacggcagacttctcctcaggagtcaggtgcaccatggtgtctgtttgag

SEQ ID NO: 391 - DNA, 17 bp, Homo sapiens
tgccctgtggggcaagg

SEQ ID NO: 392 - DNA, 17 bp, Homo sapiens
ccttgccccacagggca

SEQ ID NO: 393 - DNA, 121 bp, Homo sapiens
acagacaccatggtgcacctgactcctgaggagaagtctgccgttactgccctgtggggcaaggtgaacgtggatgaagttggtggtgaggccctgggcaggttggtatcaaggttacaag

SEQ ID NO: 394 - DNA, 121 bp, Homo sapiens
cttgtaaccttgataccaacctgcccagggcctcaccaccaacttcatccacgttcaccttgccccacagggcagtaacggcagacttctcctcaggagtcaggtgcaccatggtgtctgt

SEQ ID NO: 395 - DNA, 17 bp, Homo sapiens
tgtggggcaaggtgaac

SEQ ID NO: 396 - DNA, 17 bp, Homo sapiens
gttcaccttgccccaca

SEQ ID NO: 397 - DNA, 121 bp, Homo sapiens
ccatggtgcacctgactcctgaggagaagtctgccgttactgccctgtggggcaaggtgaacgtggatgaagttggtggtgaggccctgggcaggttggtatcaaggttacaagacaggtt

SEQ ID NO: 398 - DNA, 121 bp, Homo sapiens
aacctgtcttgtaaccttgataccaacctgcccagggcctcaccaccaacttcatccacgttcaccttgccccacagggcagtaacggcagacttctcctcaggagtcaggtgcaccatgg

SEQ ID NO: 399 - DNA, 17 bp, Homo sapiens
caaggtgaacgtggatg

SEQ ID NO: 400 - DNA, 17 bp, Homo sapiens
catccacgttcaccttg

SEQ ID NO: 401 - DNA, 121 bp, Homo sapiens
acctgactcctgaggagaagtctgccgttactgccctgtggggcaaggtgaacgtggatgaagttggtggtgaggccctgggcaggttggtatcaaggttacaagacaggtttaaggagac

SEQ ID NO: 402 - DNA, 121 bp, Homo sapiens
gtctccttaaacctgtcttgtaaccttgataccaacctgcccagggcctcaccaccaacttcatccacgttcaccttgccccacagggcagtaacggcagacttctcctcaggagtcaggt

SEQ ID NO: 403 - DNA, 17 bp, Homo sapiens
cgtggatgaagttggtg

SEQ ID NO: 404 - DNA, 17 bp, Homo sapiens
caccaacttcatccacg

SEQ ID NO: 405 - DNA, 121 bp, Homo sapiens
cacctgactcctgaggagaagtctgccgttactgccctgtggggcaaggtgaacgtggatgaagttggtggtgaggccctgggcaggttggtatcaaggttacaagacaggtttaaggaga

SEQ ID NO: 406 - DNA, 121 bp, Homo sapiens
tctccttaaacctgtcttgtaaccttgataccaacctgcccagggcctcaccaccaacttcatccacgttcaccttgccccacagggcagtaacggcagacttctcctcaggagtcaggtg

SEQ ID NO: 407 - DNA, 17 bp, Homo sapiens
acgtggatgaagttggt

SEQ ID NO: 408 - DNA, 17 bp, Homo sapiens
accaacttcatccacgt

SEQ ID NO: 409 - DNA, 121 bp, Homo sapiens
gaggagaagactgctgtcaatgccctgtggggcaaagtgaacgtggatgcagttggtggtgaggccctgggcaggttggtatcaaggttataagagaggctcaaggaggcaaatggaaact

SEQ ID NO: 410 - DNA, 121 bp, Homo sapiens
agtttccatttgcctccttgagcctctcttataaccttgataccaacctgcccagggcctcaccaccaactgcatccacgttcactttgccccacagggcattgacagcagtcttctcctc

SEQ ID NO: 411 - DNA, 17 bp, Homo sapiens
ttggtggtgaggccctg

SEQ ID NO: 412 - DNA, 17 bp, Homo sapiens
cagggcctcaccaccaa

SEQ ID NO: 413 - DNA, 121 bp, Homo sapiens; identical to SEQ ID NO: 409

SEQ ID NO: 414 - DNA, 121 bp, Homo sapiens; identical to SEQ ID NO: 410

SEQ ID NO: 415 - DNA, 17 bp, Homo sapiens
ttggtggtgaggccctg

SEQ ID NO: 416 - DNA, 17 bp, Homo sapiens
cagggcctcaccaccaa

SEQ ID NO: 417 - DNA, 121 bp, Homo sapiens
gagaagactgctgtcaatgccctgtggggcaaagtgaacgtggatgcagttggtggtgaggccctgggcaggttggtatcaaggttataagagaggctcaaggaggcaaatggaaactggg

SEQ ID NO: 418 - DNA, 121 bp, Homo sapiens
cccagtttccatttgcctccttgagcctctcttataaccttgataccaacctgcccagggcctcaccaccaactgcatccacgttcactttgccccacagggcattgacagcagtcttctc

SEQ ID NO: 419 - DNA, 17 bp, Homo sapiens
gtggtgaggccctgggc

SEQ ID NO: 420 - DNA, 17 bp, Homo sapiens
gcccagggcctcaccac

SEQ ID NO: 421 - DNA, 121 bp, Homo sapiens
ctgtcaatgccctgtggggcaaagtgaacgtggatgcagttggtggtgaggccctgggcaggttggtatcaaggttataagagaggctcaaggaggcaaatggaaactgggcatgtgtaga

SEQ ID NO: 422 - DNA, 121 bp, Homo sapiens
tctacacatgcccagtttccatttgcctccttgagcctctcttataaccttgataccaacctgcccagggcctcaccaccaactgcatccacgttcactttgccccacagggcattgacag

SEQ ID NO: 423 - DNA, 17 bp, Homo sapiens
cctgggcaggttggtat

SEQ ID NO: 424 - DNA, 17 bp, Homo sapiens
ataccaacctgcccagg

SEQ ID NO: 425 - DNA, 121 bp, Homo sapiens
tgggtttctgataggcactgactctctgtcccttgggctgttttcctaccctcagattactggtggtctacccttggacccagaggttctttgagtcctttggggatctgtcctctcctga

SEQ ID NO: 426 - DNA, 121 bp, Homo sapiens
tcaggagaggacagatccccaaaggactcaaagaacctctgggtccaagggtagaccaccagtaatctgagggtaggaaaacagcccaagggacagagagtcagtgcctatcagaaaccca

SEQ ID NO: 427 - DNA, 17 bp, Homo sapiens
cagattactggtggtct

SEQ ID NO: 428 - DNA, 17 bp, Homo sapiens
agaccaccagtaatctg

SEQ ID NO: 429 - DNA, 121 bp, Homo sapiens
ataggcactgactctctgtcccttgggctgttttcctaccctcagattactggtggtctacccttggacccagaggttctttgagtcctttggggatctgtcctctcctgatgctgttatg

SEQ ID NO: 430 - DNA, 121 bp, Homo sapiens
cataacagcatcaggagaggacagatccccaaaggactcaaagaacctctgggtccaagggtagaccaccagtaatctgagggtaggaaaacagcccaagggacagagagtcagtgcctat

SEQ ID NO: 431 - DNA, 17 bp, Homo sapiens
gtggtctacccttggac

SEQ ID NO: 432 - DNA, 17 bp, Homo sapiens
gtccaagggtagaccac

SEQ ID NO: 433 - DNA, 121 bp, Homo sapiens
actgactctctgtcccttgggctgttttcctaccctcagattactggtggtctacccttggacccagaggttctttgagtcctttggggatctgtcctctcctgatgctgttatgggcaac

SEQ ID NO: 434 - DNA, 121 bp, Homo sapiens
gttgcccataacagcatcaggagaggacagatccccaaaggactcaaagaacctctgggtccaagggtagaccaccagtaatctgagggtaggaaaacagcccaagggacagagagtcagt

SEQ ID NO: 435 - DNA, 17 bp, Homo sapiens
tacccttggacccagag

SEQ ID NO: 436 - DNA, 17 bp, Homo sapiens
ctctgggtccaagggta

SEQ ID NO: 437 - DNA, 121 bp, Homo sapiens
cactgactctctgtcccttgggctgttttcctaccctcagattactggtggtctacccttggacccagaggttctttgagtcctttggggatctgtcctctcctgatgctgttatgggcaa

SEQ ID NO: 438 - DNA, 121 bp, Homo sapiens
ttgcccataacagcatcaggagaggacagatccccaaaggactcaaagaacctctgggtccaagggtagaccaccagtaatctgagggtaggaaaacagcccaagggacagagagtcagtg

SEQ ID NO: 439 - DNA, 17 bp, Homo sapiens
ctacccttggacccaga

SEQ ID NO: 440 - DNA, 17 bp, Homo sapiens
tctgggtccaagggtag

SEQ ID NO: 441 - DNA, 121 bp, Homo sapiens
actctctgtcccttgggctgttttcctaccctcagattactggtggtctacccttggacccagaggttctttgagtcctttggggatctgtcctctcctgatgctgttatgggcaacccta

SEQ ID NO: 442 - DNA, 121 bp, Homo sapiens
tagggttgcccataacagcatcaggagaggacagatccccaaaggactcaaagaacctctgggtccaagggtagaccaccagtaatctgagggtaggaaaacagcccaagggacagagagt

SEQ ID NO: 443 - DNA, 17 bp, Homo sapiens
cttggacccagaggttc

SEQ ID NO: 444 - DNA, 17 bp, Homo sapiens
gaacctctgggtccaag

SEQ ID NO: 445 - DNA, 121 bp, Homo sapiens
ttgggctgttttcctaccctcagattactggtggtctacccttggacccagaggttctttgagtcctttggggatctgtcctctcctgatgctgttatgggcaaccctaaggtgaaggctc

SEQ ID NO: 446 - DNA, 121 bp, Homo sapiens
gagccttcaccttagggttgcccataacagcatcaggagaggacagatccccaaaggactcaaagaacctctgggtccaagggtagaccaccagtaatctgagggtaggaaaacagcccaa

SEQ ID NO: 447 - DNA, 17 bp, Homo sapiens
ggttctttgagtccttt

SEQ ID NO: 448 - DNA, 17 bp, Homo sapiens
aaaggactcaaagaacc

SEQ ID NO: 449 - DNA, 121 bp, Homo sapiens
ttctttgagtcctttggggatctgtcctctcctgatgctgttatgggcaaccctaaggtgaaggctcatggcaagaaggtgctaggtgcctttagtgatggcctggctcacctggacaacc

SEQ ID NO: 450 - DNA, 121 bp, Homo sapiens
ggttgtccaggtgagccaggccatcactaaaggcacctagcaccttcttgccatgagccttcaccttagggttgcccataacagcatcaggagaggacagatccccaaaggactcaaagaa

SEQ ID NO: 451 - DNA, 17 bp, Homo sapiens
ctaaggtgaaggctcat

SEQ ID NO: 452 - DNA, 17 bp, Homo sapiens
atgagccttcaccttag

SEQ ID NO: 453 - DNA, 121 bp, Homo sapiens
tgctgttatgggcaaccctaaggtgaaggctcatggcaagaaggtgctaggtgcctttagtgatggcctggctcacctggacaacctcaagggcactttttctcagctgagtgagctgcac

SEQ ID NO: 454 - DNA, 121 bp, Homo sapiens
gtgcagctcactcagctgagaaaaagtgcccttgaggttgtccaggtgagccaggccatcactaaaggcacctagcaccttcttgccatgagccttcaccttagggttgcccataacagca

SEQ ID NO: 455 - DNA, 17 bp, Homo sapiens
gcctttagtgatggcct

SEQ ID NO: 456 - DNA, 17 bp, Homo sapiens
aggccatcactaaaggc

SEQ ID NO: 457 - DNA, 121 bp, Homo sapiens
ttatgggcaaccctaaggtgaaggctcatggcaagaaggtgctaggtgcctttagtgatggcctggctcacctggacaacctcaagggcactttttctcagctgagtgagctgcactgtga

SEQ ID NO: 458 - DNA, 121 bp, Homo sapiens
tcacagtgcagctcactcagctgagaaaaagtgcccttgaggttgtccaggtgagccaggccatcactaaaggcacctagcaccttcttgccatgagccttcaccttagggttgcccataa

SEQ ID NO: 459 - DNA, 17 bp, Homo sapiens
tagtgatggcctggctc

SEQ ID NO: 460 - DNA, 17 bp, Homo sapiens
gagccaggccatcacta

SEQ ID NO: 461 - DNA, 121 bp, Homo sapiens
gcctttagtgatggcctggctcacctggacaacctcaagggcacctttgccacactgagtgagctgcactgtgacaagctgcacgtggatcctgagaacttcagggtgagtctatgggacc

SEQ ID NO: 462 - DNA, 121 bp, Homo sapiens
ggtcccatagactcaccctgaagttctcaggatccacgtgcagcttgtcacagtgcagctcactcagtgtggcaaaggtgcccttgaggttgtccaggtgagccaggccatcactaaaggc

SEQ ID NO: 463 - DNA, 17 bp, Homo sapiens
cactgagtgagctgcac

SEQ ID NO: 464 - DNA, 17 bp, Homo sapiens
gtgcagctcactcagtg

SEQ ID NO: 465 - DNA, 121 bp, Homo sapiens
ctggacaacctcaagggcactttttctcagctgagtgagctgcactgtgacaagctgcacgtggatcctgagaacttcagggtgagtccaggagatgcttcacttttctctttttactttc

SEQ ID NO: 466 - DNA, 121 bp, Homo sapiens
gaaagtaaaaagagaaaagtgaagcatctcctggactcaccctgaagttctcaggatccacgtgcagcttgtcacagtgcagctcactcagctgagaaaaagtgcccttgaggttgtccag

SEQ ID NO: 467 - DNA, 17 bp, Homo sapiens
agctgcacgtggatcct

SEQ ID NO: 468 - DNA, 17 bp, Homo sapiens
aggatccacgtgcagct

SEQ ID NO: 469 - DNA, 121 bp, Homo sapiens
cccttttgctaatcatgttcatacctcttatcttcctcccacagctcctgggcaacgtgctggtctgtgtgctggcccatcactttggcaaagaattcaccccaccagtgcaggctgccta

SEQ ID NO: 470 - DNA, 121 bp, Homo sapiens
taggcagcctgcactggtggggtgaattctttgccaaagtgatgggccagcacacagaccagcacgttgcccaggagctgtgggaggaagataagaggtatgaacatgattagcaaaaggg

SEQ ID NO: 471 - DNA, 17 bp, Homo sapiens
caacgtgctggtctgtg

SEQ ID NO: 472 - DNA, 17 bp, Homo sapiens
cacagaccagcacgttg

SEQ ID NO: 473 - DNA, 121 bp, Homo sapiens
gctaatcatgttcatacctcttatcttcctcccacagctcctgggcaacgtgctggtctgtgtgctggcccatcactttggcaaagaattcaccccaccagtgcaggctgcctatcagaaa

SEQ ID NO: 474 - DNA, 121 bp, Homo sapiens
tttctgataggcagcctgcactggtggggtgaattctttgccaaagtgatgggccagcacacagaccagcacgttgcccaggagctgtgggaggaagataagaggtatgaacatgattagc

SEQ ID NO: 475 - DNA, 17 bp, Homo sapiens
ctggtctgtgtgctggc

SEQ ID NO: 476 - DNA, 17 bp, Homo sapiens
gccagcacacagaccag

SEQ ID NO: 477 - DNA, 121 bp, Homo sapiens
tcatgttcatacctcttatcttcctcccacagctcctgggcaacgtgctggtctgtgtgctggcccatcactttggcaaagaattcaccccaccagtgcaggctgcctatcagaaagtggt

SEQ ID NO: 478 - DNA, 121 bp, Homo sapiens
accactttctgataggcagcctgcactggtggggtgaattctttgccaaagtgatgggccagcacacagaccagcacgttgcccaggagctgtgggaggaagataagaggtatgaacatga

SEQ ID NO: 479 - DNA, 17 bp, Homo sapiens
ctgtgtgctggcccatc

SEQ ID NO: 480 - DNA, 17 bp, Homo sapiens
gatgggccagcacacag

SEQ ID NO: 481 - DNA, 121 bp, Homo sapiens
tgttcatacctcttatcttcctcccacagctcctgggcaacgtgctggtctgtgtgctggcccatcactttggcaaagaattcaccccaccagtgcaggctgcctatcagaaagtggtggc

SEQ ID NO: 482 - DNA, 121 bp, Homo sapiens
gccaccactttctgataggcagcctgcactggtggggtgaattctttgccaaagtgatgggccagcacacagaccagcacgttgcccaggagctgtgggaggaagataagaggtatgaaca

SEQ ID NO: 483 - DNA, 17 bp, Homo sapiens
tgtgctggcccatcact

SEQ ID NO: 484 - DNA, 17 bp, Homo sapiens
agtgatgggccagcaca

SEQ ID NO: 485 - DNA, 121 bp, Homo sapiens
ttcctcccacagctcctgggcaacgtgctggtctgtgtgctggcccatcactttggcaaagaattcaccccaccagtgcaggctgcctatcagaaagtggtggctggtgtggctaatgccc

SEQ ID NO: 486 - DNA, 121 bp, Homo sapiens
gggcattagccacaccagccaccactttctgataggcagcctgcactggtggggtgaattctttgccaaagtgatgggccagcacacagaccagcacgttgcccaggagctgtgggaggaa

SEQ ID NO: 487 - DNA, 17 bp, Homo sapiens
ttggcaaagaattcacc

SEQ ID NO: 488 - DNA, 17 bp, Homo sapiens
ggtgaattctttgccaa

SEQ ID NO: 489 - DNA, 121 bp, Homo sapiens
gcaacgtgctggtctgtgtgctggcccatcactttggcaaagaattcaccccaccagtgcaggctgcctatcagaaagtggtggctggtgtggctaatgccctggcccacaagtatcacta

SEQ ID NO: 490 - DNA, 121 bp, Homo sapiens
tagtgatacttgtgggccagggcattagccacaccagccaccactttctgataggcagcctgcactggtggggtgaattctttgccaaagtgatgggccagcacacagaccagcacgttgc

SEQ ID NO: 491 - DNA, 17 bp, Homo sapiens
accagtgcaggctgcct

SEQ ID NO: 492 - DNA, 17 bp, Homo sapiens
aggcagcctgcactggt

SEQ ID NO: 493 - DNA, 121 bp, Homo sapiens
ggcaacgtgctggtctgtgtgctggcccatcactttggcaaagaattcaccccaccagtgcaggctgcctatcagaaagtggtggctggtgtggctaatgccctggcccacaagtatcact

SEQ ID NO: 494 - DNA, 121 bp, Homo sapiens
agtgatacttgtgggccagggcattagccacaccagccaccactttctgataggcagcctgcactggtggggtgaattctttgccaaagtgatgggccagcacacagaccagcacgttgcc

SEQ ID NO: 495 - DNA, 17 bp, Homo sapiens
caccagtgcaggctgcc

SEQ ID NO: 496 - DNA, 17 bp, Homo sapiens
ggcagcctgcactggtg

SEQ ID NO: 497 - DNA, 121 bp, Homo sapiens
gtctgtgtgctggcccatcactttggcaaagaattcaccccaccagtgcaggctgcctatcagaaagtggtggctggtgtggctaatgccctggcccacaagtatcactaagctcgctttc

SEQ ID NO: 498 - DNA, 121 bp, Homo sapiens
gaaagcgagcttagtgatacttgtgggccagggcattagccacaccagccaccactttctgataggcagcctgcactggtggggtgaattctttgccaaagtgatgggccagcacacagac

SEQ ID NO: 499 - DNA, 17 bp, Homo sapiens
ctgcctatcagaaagtg

SEQ ID NO: 500 - DNA, 17 bp, Homo sapiens
cactttctgataggcag

SEQ ID NO: 501 - DNA, 121 bp, Homo sapiens
aatatttgatctttattttttgttcccagggaggttatattcaaaagaaaaaggaactgtggggaatctgtatctttattgcagcagttgacctagatgagatgtcgttcacttttactga

SEQ ID NO: 502 - DNA, 121 bp, Homo sapiens
tcagtaaaagtgaacgacatctcatctaggtcaactgctgcaataaagatacagattccccacagttcctttttcttttgaatataacctccctgggaacaaaaaataaagatcaaatatt

SEQ ID NO: 503 - DNA, 17 bp, Homo sapiens
ggaactgtggggaatct

SEQ ID NO: 504 - DNA, 17 bp, Homo sapiens
agattccccacagttcc

SEQ ID NO: 505 - DNA, 121 bp, Homo sapiens
atttacttttttctattctttcctttgtagtgtccataaattctttaacttactaaaagaaattgataccagtaccaaagttgataatgctatgtcaagactgttgaagaagtatgatgta

SEQ ID NO: 506 - DNA, 121 bp, Homo sapiens
tacatcatacttcttcaacagtcttgacatagcattatcaactttggtactggtatcaatttcttttagtaagttaaagaatttatggacactacaaaggaaagaatagaaaaaagtaaat

SEQ ID NO: 507 - DNA, 17 bp, Homo sapiens
ctaaaagaaattgatac

SEQ ID NO: 508 - DNA, 17 bp, Homo sapiens
gtatcaatttcttttag

SEQ ID NO: 509 - DNA, 121 bp, Homo sapiens
tgatttacttttttctattctttcctttgtagtgtccataaattctttaacttactaaaagaaattgataccagtaccaaagttgataatgctatgtcaagactgttgaagaagtatgatg

SEQ ID NO: 510 - DNA, 121 bp, Homo sapiens
catcatacttcttcaacagtcttgacatagcattatcaactttggtactggtatcaatttcttttagtaagttaaagaatttatggacactacaaaggaaagaatagaaaaaagtaaatca

SEQ ID NO: 511 - DNA, 17 bp, Homo sapiens
tactaaaagaaattgat

SEQ ID NO: 512 - DNA, 17 bp, Homo sapiens
atcaatttcttttagta

SEQ ID NO: 513 - DNA, 121 bp, Homo sapiens
aaaatgttaaaaagtcataatgtttttcttttcaggacatgtgaacttatatatttgacacaacccagcagttcgtaagtagttcacagaatgttatttttcacttaaaaaaaaagatttt

SEQ ID NO: 514 - DNA, 121 bp, Homo sapiens
aaaatctttttttttaagtgaaaaataacattctgtgaactacttacgaactgctgggttgtgtcaaatatataagttcacatgtcctgaaaagaaaaacattatgactttttaacatttt

SEQ ID NO: 515 - DNA, 17 bp, Homo sapiens
atttgacacaacccagc

SEQ ID NO: 516 - DNA, 17 bp, Homo sapiens
gctgggttgtgtcaaat

SEQ ID NO: 517 - DNA, 121 bp, Homo sapiens
tgatacatttttcctgttttttttctgctttctatttgtttaataggatatctactgaaataaattctgcattggtgctaaaagtttcttggatcacatttttattagctaaaggtaagtt

SEQ ID NO: 518 - DNA, 121 bp, Homo sapiens
aacttacctttagctaataaaaatgtgatccaagaaacttttagcaccaatgcagaatttatttcagtagatatcctattaaacaaatagaaagcagaaaaaaaacaggaaaaatgtatca

SEQ ID NO: 519 - DNA, 17 bp, Homo sapiens
tactgaaataaattctg

SEQ ID NO: 520 - DNA, 17 bp, Homo sapiens
cagaatttatttcagta

SEQ ID NO: 521 - DNA, 121 bp, Homo sapiens
aaagatctgaatctctaactttctttaaaaatgtacatttttttttcaggggaagtattacaaatggaagatgatctggtgatttcatttcagttaatgctatgtgtccttgactatttta

SEQ ID NO: 522 - DNA, 121 bp, Homo sapiens
taaaatagtcaaggacacatagcattaactgaaatgaaatcaccagatcatcttccatttgtaatacttcccctgaaaaaaaaatgtacatttttaaagaaagttagagattcagatcttt

SEQ ID NO: 523 - DNA, 17 bp, Homo sapiens
aagtattacaaatggaa

SEQ ID NO: 524 - DNA, 17 bp, Homo sapiens
ttccatttgtaatactt

SEQ ID NO: 525 - DNA, 121 bp, Homo sapiens
gttcttatctaatttaccacttttacagaaacagctgttatacccattaatggttcacctcgaacacccaggcgaggtcagaacaggagtgcacggatagcaaaacaactagaaaatgata

SEQ ID NO: 526 - DNA, 121 bp, Homo sapiens
tatcattttctagttgttttgctatccgtgcactcctgttctgacctcgcctgggtgttcgaggtgaaccattaatgggtataacagctgtttctgtaaaagtggtaaattagataagaac

SEQ ID NO: 527 - DNA, 17 bp, Homo sapiens
gttcacctcgaacaccc

SEQ ID NO: 528 - DNA, 17 bp, Homo sapiens
gggtgttcgaggtgaac

SEQ ID NO: 529 - DNA, 121 bp, Homo sapiens
tttaccacttttacagaaacagctgttatacccattaatggttcacctcgaacacccaggcgaggtcagaacaggagtgcacggatagcaaaacaactagaaaatgatacaagaattattg

SEQ ID NO: 530 - DNA, 121 bp, Homo sapiens
caataattcttgtatcattttctagttgttttgctatccgtgcactcctgttctgacctcgcctgggtgttcgaggtgaaccattaatgggtataacagctgtttctgtaaaagtggtaaa

SEQ ID NO: 531 - DNA, 17 bp, Homo sapiens
cacccaggcgaggtcag

SEQ ID NO: 532 - DNA, 17 bp, Homo sapiens
ctgacctcgcctgggtg

SEQ ID NO: 533 - DNA, 121 bp, Homo sapiens
attaatggttcacctcgaacacccaggcgaggtcagaacaggagtgcacggatagcaaaacaactagaaaatgatacaagaattattgaagttctctgtaaagaacatgaatgtaatatag

SEQ ID NO: 534 - DNA, 121 bp, Homo sapiens
ctatattacattcatgttctttacagagaacttcaataattcttgtatcattttctagttgttttgctatccgtgcactcctgttctgacctcgcctgggtgttcgaggtgaaccattaat

SEQ ID NO: 535 - DNA, 17 bp, Homo sapiens
tagcaaaacaactagaa

SEQ ID NO: 536 - DNA, 17 bp, Homo sapiens
ttctagttgttttgcta

SEQ ID NO: 537 - DNA, 121 bp, Homo sapiens
tgacatgtaaaggataattgtcagtgacttttttctttcaaggttgaaaatctttctaaacgatacgaagaaatttatcttaaaaataaagatctagatgcaagattatttttggatcatg

SEQ ID NO: 538 - DNA, 121 bp, Homo sapiens
catgatccaaaaataatcttgcatctagatctttatttttaagataaatttcttcgtatcgtttagaaagattttcaaccttgaaagaaaaaagtcactgacaattatcctttacatgtca

SEQ ID NO: 539 - DNA, 17 bp, Homo sapiens
tttctaaacgatacgaa

SEQ ID NO: 540 - DNA, 17 bp, Homo sapiens
ttcgtatcgtttagaaa

SEQ ID NO: 541 - DNA, 121 bp, Homo sapiens
acaaattgtaaattttcagtatgtgaatgacttcacttattgttatttagttttgaaacacagagaacaccacgaaaaagtaaccttgatgaagaggtgaatgtaattcctccacacactc

SEQ ID NO: 542 - DNA, 121 bp, Homo sapiens
gagtgtgtggaggaattacattcacctcttcatcaaggttactttttcgtggtgttctctgtgtttcaaaactaaataacaataagtgaagtcattcacatactgaaaatttacaatttgt

SEQ ID NO: 543 - DNA, 17 bp, Homo sapiens
ttgaaacacagagaaca

SEQ ID NO: 544 - DNA, 17 bp, Homo sapiens
tgttctctgtgtttcaa

SEQ ID NO: 545 - DNA, 121 bp, Homo sapiens
ttttcagtatgtgaatgacttcacttattgttatttagttttgaaacacagagaacaccacgaaaaagtaaccttgatgaagaggtgaatgtaattcctccacacactccagttaggtatg

SEQ ID NO: 546 - DNA, 121 bp, Homo sapiens
catacctaactggagtgtgtggaggaattacattcacctcttcatcaaggttactttttcgtggtgttctctgtgtttcaaaactaaataacaataagtgaagtcattcacatactgaaaa

SEQ ID NO: 547 - DNA, 17 bp, Homo sapiens
gaacaccacgaaaaagt

SEQ ID NO: 548 - DNA, 17 bp, Homo sapiens
actttttcgtggtgttc

SEQ ID NO: 549 - DNA, 121 bp, Homo sapiens; identical to SEQ ID NO: 545

SEQ ID NO: 550 - DNA, 121 bp, Homo sapiens; identical to SEQ ID NO: 546

SEQ ID NO: 551 - DNA, 17 bp, Homo sapiens
gaacaccacgaaaaagt

SEQ ID NO: 552 - DNA, 17 bp, Homo sapiens
actttttcgtggtgttc

SEQ ID NO: 553 - DNA, 121 bp, Homo sapiens
ctgttatgaacactatccaacaattaatgatgattttaaattcagcaagtgatcaaccttcagaaaatctgatttcctattttaacgtaagccatatatgaaacattatttattgtaatat

SEQ ID NO: 554 - DNA, 121 bp, Homo sapiens
atattacaataaataatgtttcatatatggcttacgttaaaataggaaatcagattttctgaaggttgatcacttgctgaatttaaaatcatcattaattgttggatagtgttcataacag

SEQ ID NO: 555 - DNA, 17 bp, Homo sapiens
tcaaccttcagaaaatc

SEQ ID NO: 556 - DNA, 17 bp, Homo sapiens
gattttctgaaggttga

SEQ ID NO: 557 - DNA, 121 bp, Homo sapiens
tttcataattgtgattttctaaaatagcaggctcttatttttctttttgtttgtttgtagcgatacaaacttggagttcgcttgtattaccgagtaatggaatccatgcttaaatcagtaa

SEQ ID NO: 558 - DNA, 121 bp, Homo sapiens
ttactgatttaagcatggattccattactcggtaatacaagcgaactccaagtttgtatcgctacaaacaaacaaaaagaaaaataagagcctgctattttagaaaatcacaattatgaaa

SEQ ID NO: 559 - DNA, 17 bp, Homo sapiens
gtttgtagcgatacaaa

SEQ ID NO: 560 - DNA, 17 bp, Homo sapiens
tttgtatcgctacaaac

SEQ ID NO: 561 - DNA, 121 bp, Homo sapiens
gctcttatttttctttttgtttgtttgtagcgatacaaacttggagttcgcttgtattaccgagtaatggaatccatgcttaaatcagtaagttaaaaacaatataaaaaaatttcagccg

SEQ ID NO: 562 - DNA, 121 bp, Homo sapiens
cggctgaaatttttttatattgtttttaacttactgatttaagcatggattccattactcggtaatacaagcgaactccaagtttgtatcgctacaaacaaacaaaaagaaaaataagagc

SEQ ID NO: 563 - DNA, 17 bp, Homo sapiens
tgtattaccgagtaatg

SEQ ID NO: 564 - DNA, 17 bp, Homo sapiens
cattactcggtaataca

SEQ ID NO: 565 - DNA, 121 bp, Homo sapiens
atcgaaagttttatcaaagcagaaggcaacttgacaagagaaatgataaaacatttagaacgatgtgaacatcgaatcatggaatcccttgcatggctctcagtaagtagctaaataattg

SEQ ID NO: 566 - DNA, 121 bp, Homo sapiens
caattatttagctacttactgagagccatgcaagggattccatgattcgatgttcacatcgttctaaatgttttatcatttctcttgtcaagttgccttctgctttgataaaactttcgat

SEQ ID NO: 567 - DNA, 17 bp, Homo sapiens
atttagaacgatgtgaa

SEQ ID NO: 568 - DNA, 17 bp, Homo sapiens
ttcacatcgttctaaat

SEQ ID NO: 569 - DNA, 121 bp, Homo sapiens
aagttttatcaaagcagaaggcaacttgacaagagaaatgataaaacatttagaacgatgtgaacatcgaatcatggaatcccttgcatggctctcagtaagtagctaaataattgaagaa

SEQ ID NO: 570 - DNA, 121 bp, Homo sapiens
ttcttcaattatttagctacttactgagagccatgcaagggattccatgattcgatgttcacatcgttctaaatgttttatcatttctcttgtcaagttgccttctgctttgataaaactt

SEQ ID NO: 571 - DNA, 17 bp, Homo sapiens
gaacgatgtgaacatcg

SEQ ID NO: 572 - DNA, 17 bp, Homo sapiens
cgatgttcacatcgttc

SEQ ID NO: 573 - DNA, 121 bp, Homo sapiens
agttttatcaaagcagaaggcaacttgacaagagaaatgataaaacatttagaacgatgtgaacatcgaatcatggaatcccttgcatggctctcagtaagtagctaaataattgaagaaa

SEQ ID NO: 574 - DNA, 121 bp, Homo sapiens
tttcttcaattatttagctacttactgagagccatgcaagggattccatgattcgatgttcacatcgttctaaatgttttatcatttctcttgtcaagttgccttctgctttgataaaact

SEQ ID NO: 575 - DNA, 17 bp, Homo sapiens
aacgatgtgaacatcga

SEQ ID NO: 576 - DNA, 17 bp, Homo sapiens
tcgatgttcacatcgtt

SEQ ID NO: 577 - DNA, 121 bp, Homo sapiens
tacctgggaaaattatgcttactaatgtggttttaatttcatcatgtttcatataggattcacctttatttgatcttattaaacaatcaaaggaccgagaaggaccaactgatcaccttga

SEQ ID NO: 578 - DNA, 121 bp, Homo sapiens
tcaaggtgatcagttggtccttctcggtcctttgattgtttaataagatcaaataaaggtgaatcctatatgaaacatgatgaaattaaaaccacattagtaagcataattttcccaggta

SEQ ID NO: 579 - DNA, 17 bp, Homo sapiens
ataggattcacctttat

SEQ ID NO: 580 - DNA, 17 bp, Homo sapiens
ataaaggtgaatcctat

SEQ ID NO: 581 - DNA, 121 bp, Homo sapiens
aatgtggttttaatttcatcatgtttcatataggattcacctttatttgatcttattaaacaatcaaaggaccgagaaggaccaactgatcaccttgaatctgcttgtcctcttaatcttc

SEQ ID NO: 582 - DNA, 121 bp, Homo sapiens
gaagattaagaggacaagcagattcaaggtgatcagttggtccttctcggtcctttgattgtttaataagatcaaataaaggtgaatcctatatgaaacatgatgaaattaaaaccacatt

SEQ ID NO: 583 - DNA, 17 bp, Homo sapiens
ttattaaacaatcaaag

SEQ ID NO: 584 - DNA, 17 bp, Homo sapiens
ctttgattgtttaataa

SEQ ID NO: 585 - DNA, 121 bp, Homo sapiens
atttcatcatgtttcatataggattcacctttatttgatcttattaaacaatcaaaggaccgagaaggaccaactgatcaccttgaatctgcttgtcctcttaatcttcctctccagaata

SEQ ID NO: 586 - DNA, 121 bp, Homo sapiens
tattctggagaggaagattaagaggacaagcagattcaaggtgatcagttggtccttctcggtcctttgattgtttaataagatcaaataaaggtgaatcctatatgaaacatgatgaaat

SEQ ID NO: 587 - DNA, 17 bp, Homo sapiens
caaaggaccgagaagga

SEQ ID NO: 588 - DNA, 17 bp, Homo sapiens
tccttctcggtcctttg

SEQ ID NO: 589 - DNA, 121 bp, Homo sapiens
tcatcatgtttcatataggattcacctttatttgatcttattaaacaatcaaaggaccgagaaggaccaactgatcaccttgaatctgcttgtcctcttaatcttcctctccagaataatc

SEQ ID NO: 590 - DNA, 121 bp, Homo sapiens
gattattctggagaggaagattaagaggacaagcagattcaaggtgatcagttggtccttctcggtcctttgattgtttaataagatcaaataaaggtgaatcctatatgaaacatgatga

SEQ ID NO: 591 - DNA, 17 bp, Homo sapiens
aggaccgagaaggacca

SEQ ID NO: 592 - DNA, 17 bp, Homo sapiens
tggtccttctcggtcct

SEQ ID NO: 593 - DNA, 121 bp, Homo sapiens
agaaaaaaggttcaactacgcgtgtaaattctactgcaaatgcagagacacaagcaacctcagccttccagacccagaagccattgaaatctacctctctttcactgttttataaaaaagg

SEQ ID NO: 594 - DNA, 121 bp, Homo sapiens
ccttttttataaaacagtgaaagagaggtagatttcaatggcttctgggtctggaaggctgaggttgcttgtgtctctgcatttgcagtagaatttacacgcgtagttgaaccttttttct

SEQ ID NO: 595 - DNA, 17 bp, Homo sapiens
agcaacctcagccttcc

SEQ ID NO: 596 - DNA, 17 bp, Homo sapiens
ggaaggctgaggttgct

SEQ ID NO: 597 - DNA, 121 bp, Homo sapiens
aaaaaaggttcaactacgcgtgtaaattctactgcaaatgcagagacacaagcaacctcagccttccagacccagaagccattgaaatctacctctctttcactgttttataaaaaaggtt

SEQ ID NO: 598 - DNA, 121 bp, Homo sapiens
aaccttttttataaaacagtgaaagagaggtagatttcaatggcttctgggtctggaaggctgaggttgcttgtgtctctgcatttgcagtagaatttacacgcgtagttgaacctttttt

SEQ ID NO: 599 - DNA, 17 bp, Homo sapiens
caacctcagccttccag

SEQ ID NO: 600 - DNA, 17 bp, Homo sapiens
ctggaaggctgaggttg

SEQ ID NO: 601 - DNA, 121 bp, Homo sapiens
actacgcgtgtaaattctactgcaaatgcagagacacaagcaacctcagccttccagacccagaagccattgaaatctacctctctttcactgttttataaaaaaggttagtagatgatta

SEQ ID NO: 602 - DNA, 121 bp, Homo sapiens
taatcatctactaaccttttttataaaacagtgaaagagaggtagatttcaatggcttctgggtctggaaggctgaggttgcttgtgtctctgcatttgcagtagaatttacacgcgtagt

SEQ ID NO: 603 - DNA, 17 bp, Homo sapiens
tccagacccagaagcca

SEQ ID NO: 604 - DNA, 17 bp, Homo sapiens
tggcttctgggtctgga

SEQ ID NO: 605 - DNA, 121 bp, Homo sapiens
ttgtaattcaaaatgaacagtaaaaatgactaatttttcttattcccacagtgtatcggctagcctatctccggctaaatacactttgtgaacgccttctgtctgagcacccagaattaga

SEQ ID NO: 606 - DNA, 121 bp, Homo sapiens
tctaattctgggtgctcagacagaaggcgttcacaaagtgtatttagccggagataggctagccgatacactgtgggaataagaaaaattagtcatttttactgttcattttgaattacaa

SEQ ID NO: 607 - DNA, 17 bp, Homo sapiens
gtatcggctagcctatc

SEQ ID NO: 608 - DNA, 17 bp, Homo sapiens
gataggctagccgatac

SEQ ID NO: 609 - DNA, 121 bp, Homo sapiens
aatgaacagtaaaaatgactaatttttcttattcccacagtgtatcggctagcctatctccggctaaatacactttgtgaacgccttctgtctgagcacccagaattagaacatatcatct

SEQ ID NO: 610 - DNA, 121 bp, Homo sapiens
agatgatatgttctaattctgggtgctcagacagaaggcgttcacaaagtgtatttagccggagataggctagccgatacactgtgggaataagaaaaattagtcatttttactgttcatt

SEQ ID NO: 611 - DNA, 17 bp, Homo sapiens
cctatctccggctaaat

SEQ ID NO: 612 - DNA, 17 bp, Homo sapiens
atttagccggagatagg

SEQ ID NO: 613 - DNA, 121 bp, Homo sapiens
aacagtaaaaatgactaatttttcttattcccacagtgtatcggctagcctatctccggctaaatacactttgtgaacgccttctgtctgagcacccagaattagaacatatcatctggac

SEQ ID NO: 614 - DNA, 121 bp, Homo sapiens
gtccagatgatatgttctaattctgggtgctcagacagaaggcgttcacaaagtgtatttagccggagataggctagccgatacactgtgggaataagaaaaattagtcatttttactgtt

SEQ ID NO: 615 - DNA, 17 bp, Homo sapiens
tctccggctaaatacac

SEQ ID NO: 616 - DNA, 17 bp, Homo sapiens
gtgtatttagccggaga

SEQ ID NO: 617 - DNA, 121 bp, Homo sapiens
tatcggctagcctatctccggctaaatacactttgtgaacgccttctgtctgagcacccagaattagaacatatcatctggacccttttccagcacaccctgcagaatgagtatgaactca

SEQ ID NO: 618 - DNA, 121 bp, Homo sapiens
tgagttcatactcattctgcagggtgtgctggaaaagggtccagatgatatgttctaattctgggtgctcagacagaaggcgttcacaaagtgtatttagccggagataggctagccgata

SEQ ID NO: 619 - DNA, 17 bp, Homo sapiens
agcacccagaattagaa

SEQ ID NO: 620 - DNA, 17 bp, Homo sapiens
ttctaattctgggtgct

SEQ ID NO: 621 - DNA, 121 bp, Homo sapiens
tttgtgaacgccttctgtctgagcacccagaattagaacatatcatctggacccttttccagcacaccctgcagaatgagtatgaactcatgagagacaggcatttggaccaagtaagaaa

SEQ ID NO: 622 - DNA, 121 bp, Homo sapiens
tttcttacttggtccaaatgcctgtctctcatgagttcatactcattctgcagggtgtgctggaaaagggtccagatgatatgttctaattctgggtgctcagacagaaggcgttcacaaa

SEQ ID NO: 623 - DNA, 17 bp, Homo sapiens
ccttttccagcacaccc

SEQ ID NO: 624 - DNA, 17 bp, Homo sapiens
gggtgtgctggaaaagg

SEQ ID NO: 625 - DNA, 121 bp, Homo sapiens
aaaaccatgtaataaaattctgactacttttacatcaatttatttactagattatgatgtgttccatgtatggcatatgcaaagtgaagaatatagaccttaaattcaaaatcattgtaac

SEQ ID NO: 626 - DNA, 121 bp, Homo sapiens
gttacaatgattttgaatttaaggtctatattcttcactttgcatatgccatacatggaacacatcataatctagtaaataaattgatgtaaaagtagtcagaattttattacatggtttt

SEQ ID NO: 627 - DNA, 17 bp, Homo sapiens
tatgatgtgttccatgt

SEQ ID NO: 628 - DNA, 17 bp, Homo sapiens
acatggaacacatcata

SEQ ID NO: 629 - DNA, 121 bp, Homo sapiens
ttctgactacttttacatcaatttatttactagattatgatgtgttccatgtatggcatatgcaaagtgaagaatatagaccttaaattcaaaatcattgtaacagcatacaaggatcttc

SEQ ID NO: 630 - DNA, 121 bp, Homo sapiens
gaagatccttgtatgctgttacaatgattttgaatttaaggtctatattcttcactttgcatatgccatacatggaacacatcataatctagtaaataaattgatgtaaaagtagtcagaa

SEQ ID NO: 631 - DNA, 17 bp, Homo sapiens
atggcatatgcaaagtg

SEQ ID NO: 632 - DNA, 17 bp, Homo sapiens
cactttgcatatgccat

SEQ ID NO: 633 - DNA, 121 bp, Homo sapiens
gtatggcatatgcaaagtgaagaatatagaccttaaattcaaaatcattgtaacagcatacaaggatcttcctcatgctgttcaggaggtaggtaattttccatagtaagtttttttgata

SEQ ID NO: 634 - DNA, 121 bp, Homo sapiens
tatcaaaaaaacttactatggaaaattacctacctcctgaacagcatgaggaagatccttgtatgctgttacaatgattttgaatttaaggtctatattcttcactttgcatatgccatac

SEQ ID NO: 635 - DNA, 17 bp, Homo sapiens
acagcatacaaggatct

SEQ ID NO: 636 - DNA, 17 bp, Homo sapiens
agatccttgtatgctgt

SEQ ID NO: 637 - DNA, 121 bp, Homo sapiens
tttttttttttttttactgttcttcctcagacattcaaacgtgttttgatcaaagaagaggagtatgattctattatagtattctataactcggtcttcatgcagagactgaaaacaaata

SEQ ID NO: 638 - DNA, 121 bp, Homo sapiens
tatttgttttcagtctctgcatgaagaccgagttatagaatactataatagaatcatactcctcttctttgatcaaaacacgtttgaatgtctgaggaagaacagtaaaaaaaaaaaaaaa

SEQ ID NO: 639 - DNA, 17 bp, Homo sapiens
aagaagaggagtatgat

SEQ ID NO: 640 - DNA, 17 bp, Homo sapiens
atcatactcctcttctt

SEQ ID NO: 641 - DNA, 121 bp, Homo sapiens
gttttgatcaaagaagaggagtatgattctattatagtattctataactcggtcttcatgcagagactgaaaacaaatattttgcagtatgcttccaccagggtaggtcaaaagtatcctt

SEQ ID NO: 642 - DNA, 121 bp, Homo sapiens
aaggatacttttgacctaccctggtggaagcatactgcaaaatatttgttttcagtctctgcatgaagaccgagttatagaatactataatagaatcatactcctcttctttgatcaaaac

SEQ ID NO: 643 - DNA, 17 bp, Homo sapiens
tcttcatgcagagactg

SEQ ID NO: 644 - DNA, 17 bp, Homo sapiens
cagtctctgcatgaaga

SEQ ID NO: 645 - DNA, 121 bp, Homo sapiens
taatctacttttttgtttttgctctagccccctaccttgtcaccaatacctcacattcctcgaagcccttacaagtttcctagttcacccttacggattcctggagggaacatctatattt

SEQ ID NO: 646 - DNA, 121 bp, Homo sapiens
aaatatagatgttccctccaggaatccgtaagggtgaactaggaaacttgtaagggcttcgaggaatgtgaggtattggtgacaaggtagggggctagagcaaaaacaaaaaagtagatta

SEQ ID NO: 647 - DNA, 17 bp, Homo sapiens
acattcctcgaagccct

SEQ ID NO: 648 - DNA, 17 bp, Homo sapiens
agggcttcgaggaatgt

SEQ ID NO: 649 - DNA, 121 bp, Homo sapiens
ccttacggattcctggagggaacatctatatttcacccctgaagagtccatataaaatttcagaaggtctgccaacaccaacaaaaatgactccaagatcaaggtgtgtgttttctcttta

SEQ ID NO: 650 - DNA, 121 bp, Homo sapiens
taaagagaaaacacacaccttgatcttggagtcatttttgttggtgttggcagaccttctgaaattttatatggactcttcaggggtgaaatatagatgttccctccaggaatccgtaagg

SEQ ID NO: 651 - DNA, 17 bp, Homo sapiens
taaaatttcagaaggtc

SEQ ID NO: 652 - DNA, 17 bp, Homo sapiens
gaccttctgaaatttta

SEQ ID NO: 653 - DNA, 121 bp, Homo sapiens
ctgcgctcaggaggccttcaccctctgctctgggtaaagttcattggaacagaaagaaatggatttatctgctcttcgcgttgaagaagtacaaaatgtcattaatgctatgcagaaaatc

SEQ ID NO: 654 - DNA, 121 bp, Homo sapiens
gattttctgcatagcattaatgacattttgtacttcttcaacgcgaagagcagataaatccatttctttctgttccaatgaactttacccagagcagagggtgaaggcctcctgagcgcag

SEQ ID NO: 655 - DNA, 17 bp, Homo sapiens
aaagaaatggatttatc

SEQ ID NO: 656 - DNA, 17 bp, Homo sapiens
gataaatccatttcttt

SEQ ID NO: 657 - DNA, 121 bp, Homo sapiens
ctgggtaaagttcattggaacagaaagaaatggatttatctgctcttcgcgttgaagaagtacaaaatgtcattaatgctatgcagaaaatcttagagtgtcccatctgtctggagttgat

SEQ ID NO: 658 - DNA, 121 bp, Homo sapiens
atcaactccagacagatgggacactctaagattttctgcatagcattaatgacattttgtacttcttcaacgcgaagagcagataaatccatttctttctgttccaatgaactttacccag

SEQ ID NO: 659 - DNA, 17 bp, Homo sapiens
tgaagaagtacaaaatg

SEQ ID NO: 660 - DNA, 17 bp, Homo sapiens
cattttgtacttcttca

SEQ ID NO: 661 - DNA, 121 bp, Homo sapiens
atggatttatctgctcttcgcgttgaagaagtacaaaatgtcattaatgctatgcagaaaatcttagagtgtcccatctgtctggagttgatcaaggaacctgtctccacaaagtgtgacc

SEQ ID NO: 662 - DNA, 121 bp, Homo sapiens
ggtcacactttgtggagacaggttccttgatcaactccagacagatgggacactctaagattttctgcatagcattaatgacattttgtacttcttcaacgcgaagagcagataaatccat

SEQ ID NO: 663 - DNA, 17 bp, Homo sapiens
tgcagaaaatcttagag

SEQ ID NO: 664 - DNA, 17 bp, Homo sapiens
ctctaagattttctgca

SEQ ID NO: 665 - DNA, 121 bp, Homo sapiens
atttatctgctcttcgcgttgaagaagtacaaaatgtcattaatgctatgcagaaaatcttagagtgtcccatctgtctggagttgatcaaggaacctgtctccacaaagtgtgaccacat

SEQ ID NO: 666 - DNA, 121 bp, Homo sapiens
atgtggtcacactttgtggagacaggttccttgatcaactccagacagatgggacactctaagattttctgcatagcattaatgacattttgtacttcttcaacgcgaagagcagataaat

SEQ ID NO: 667 - DNA, 17 bp, Homo sapiens
gaaaatcttagagtgtc

SEQ ID NO: 668 - DNA, 17 bp, Homo sapiens
gacactctaagattttc

SEQ ID NO: 669 - DNA, 121 bp, Homo sapiens
agaaaatcttagagtgtcccatctgtctggagttgatcaaggaacctgtctccacaaagtgtgaccacatattttgcaaattttgcatgctgaaacttctcaaccagaagaaagggccttc

SEQ ID NO: 670 - DNA, 121 bp, Homo sapiens
gaaggccctttcttctggttgagaagtttcagcatgcaaaatttgcaaaatatgtggtcacactttgtggagacaggttccttgatcaactccagacagatgggacactctaagattttct

SEQ ID NO: 671 - DNA, 17 bp, Homo sapiens
cacaaagtgtgaccaca

SEQ ID NO: 672 - DNA, 17 bp, Homo sapiens
tgtggtcacactttgtg

SEQ ID NO: 673 - DNA, 121 bp, Homo sapiens
cacatattttgcaaattttgcatgctgaaacttctcaaccagaagaaagggccttcacagtgtcctttatgtaagaatgatataaccaaaaggagcctacaagaaagtacgagatttagtc

SEQ ID NO: 674 - DNA, 121 bp, Homo sapiens
gactaaatctcgtactttcttgtaggctccttttggttatatcattcttacataaaggacactgtgaaggccctttcttctggttgagaagtttcagcatgcaaaatttgcaaaatatgtg

SEQ ID NO: 675 - DNA, 17 bp, Homo sapiens
cttcacagtgtccttta

SEQ ID NO: 676 - DNA, 17 bp, Homo sapiens
taaaggacactgtgaag

SEQ ID NO: 677 - DNA, 121 bp, Homo sapiens
tttgcaaattttgcatgctgaaacttctcaaccagaagaaagggccttcacagtgtcctttatgtaagaatgatataaccaaaaggagcctacaagaaagtacgagatttagtcaacttgt

SEQ ID NO: 678 - DNA, 121 bp, Homo sapiens
acaagttgactaaatctcgtactttcttgtaggctccttttggttatatcattcttacataaaggacactgtgaaggccctttcttctggttgagaagtttcagcatgcaaaatttgcaaa

SEQ ID NO: 679 - DNA, 17 bp, Homo sapiens
gtgtcctttatgtaaga

SEQ ID NO: 680 - DNA, 17 bp, Homo sapiens
tcttacataaaggacac

SEQ ID NO: 681 - DNA, 121 bp, Homo sapiens
tgcaaattttgcatgctgaaacttctcaaccagaagaaagggccttcacagtgtcctttatgtaagaatgatataaccaaaaggagcctacaagaaagtacgagatttagtcaacttgttg

SEQ ID NO: 682 - DNA, 121 bp, Homo sapiens
caacaagttgactaaatctcgtactttcttgtaggctccttttggttatatcattcttacataaaggacactgtgaaggccctttcttctggttgagaagtttcagcatgcaaaatttgca

SEQ ID NO: 683 - DNA, 17 bp, Homo sapiens
gtcctttatgtaagaat

SEQ ID NO: 684 - DNA, 17 bp, Homo sapiens
attcttacataaaggac

SEQ ID NO: 685 - DNA, 121 bp, Homo sapiens
gcaaattttgcatgctgaaacttctcaaccagaagaaagggccttcacagtgtcctttatgtaagaatgatataaccaaaaggagcctacaagaaagtacgagatttagtcaacttgttga

SEQ ID NO: 686 - DNA, 121 bp, Homo sapiens
tcaacaagttgactaaatctcgtactttcttgtaggctccttttggttatatcattcttacataaaggacactgtgaaggccctttcttctggttgagaagtttcagcatgcaaaatttgc

SEQ ID NO: 687 - DNA, 17 bp, Homo sapiens
tcctttatgtaagaatg

SEQ ID NO: 688 - DNA, 17 bp, Homo sapiens
cattcttacataaagga

SEQ ID NO: 689 - DNA, 121 bp, Homo sapiens
cagaagaaagggccttcacagtgtcctttatgtaagaatgatataaccaaaaggagcctacaagaaagtacgagatttagtcaacttgttgaagagctattgaaaatcatttgtgcttttc

SEQ ID NO: 690 - DNA, 121 bp, Homo sapiens
gaaaagcacaaatgattttcaatagctcttcaacaagttgactaaatctcgtactttcttgtaggctccttttggttatatcattcttacataaaggacactgtgaaggccctttcttctg

SEQ ID NO: 691 - DNA, 17 bp, Homo sapiens
ggagcctacaagaaagt

SEQ ID NO: 692 - DNA, 17 bp, Homo sapiens
actttcttgtaggctcc

SEQ ID NO: 693 - DNA, 121 bp, Homo sapiens
agctattgaaaatcatttgtgcttttcagcttgacacaggtttggagtatgcaaacagctataattttgcaaaaaaggaaaataactctcctgaacatctaaaagatgaagtttctatcat

SEQ ID NO: 694 - DNA, 121 bp, Homo sapiens
atgatagaaacttcatcttttagatgttcaggagagttattttccttttttgcaaaattatagctgtttgcatactccaaacctgtgtcaagctgaaaagcacaaatgattttcaatagct

SEQ ID NO: 695 - DNA, 17 bp, Homo sapiens
aaacagctataattttg

SEQ ID NO: 696 - DNA, 17 bp, Homo sapiens
caaaattatagctgttt

SEQ ID NO: 697 - DNA, 121 bp, Homo sapiens
ctacagagtgaacccgaaaatccttccttgcaggaaaccagtctcagtgtccaactctctaaccttggaactgtgagaactctgaggacaaagcagcggatacaacctcaaaagacgtctg

SEQ ID NO: 698 - DNA, 121 bp, Homo sapiens
cagacgtcttttgaggttgtatccgctgctttgtcctcagagttctcacagttccaaggttagagagttggacactgagactggtttcctgcaaggaaggattttcgggttcactctgtag

SEQ ID NO: 699 - DNA, 17 bp, Homo sapiens
aactctctaaccttgga

SEQ ID NO: 700 - DNA, 17 bp, Homo sapiens
tccaaggttagagagtt

SEQ ID NO: 701 - DNA, 121 bp, Homo sapiens
gaaaccagtctcagtgtccaactctctaaccttggaactgtgagaactctgaggacaaagcagcggatacaacctcaaaagacgtctgtctacattgaattgggatctgattcttctgaag

SEQ ID NO: 702 - DNA, 121 bp, Homo sapiens
cttcagaagaatcagatcccaattcaatgtagacagacgtcttttgaggttgtatccgctgctttgtcctcagagttctcacagttccaaggttagagagttggacactgagactggtttc

SEQ ID NO: 703 - DNA, 17 bp, Homo sapiens
ggacaaagcagcggata

SEQ ID NO: 704 - DNA, 17 bp, Homo sapiens
tatccgctgctttgtcc

SEQ ID NO: 705 - DNA, 121 bp, Homo sapiens
ctcccagcacagaaaaaaaggtagatctgaatgctgatcccctgtgtgagagaaaagaatggaataagcagaaactgccatgctcagagaatcctagagatactgaagatgttccttggat

SEQ ID NO: 706 - DNA, 121 bp, Homo sapiens
atccaaggaacatcttcagtatctctaggattctctgagcatggcagtttctgcttattccattcttttctctcacacaggggatcagcattcagatctacctttttttctgtgctgggag

SEQ ID NO: 707 - DNA, 17 bp, Homo sapiens
aaaagaatggaataagc

SEQ ID NO: 708 - DNA, 17 bp, Homo sapiens
gcttattccattctttt

SEQ ID NO: 709 - DNA, 121 bp, Homo sapiens
atgctcagagaatcctagagatactgaagatgttccttggataacactaaatagcagcattcagaaagttaatgagtggttttccagaagtgatgaactgttaggttctgatgactcacat

SEQ ID NO: 710 - DNA, 121 bp, Homo sapiens
atgtgagtcatcagaacctaacagttcatcacttctggaaaaccactcattaactttctgaatgctgctatttagtgttatccaaggaacatcttcagtatctctaggattctctgagcat

SEQ ID NO: 711 - DNA, 17 bp, Homo sapiens
agcagcattcagaaagt

SEQ ID NO: 712 - DNA, 17 bp, Homo sapiens
actttctgaatgctgct

SEQ ID NO: 713 - DNA, 121 bp, Homo sapiens
gggagtctgaatcaaatgccaaagtagctgatgtattggacgttctaaatgaggtagatgaatattctggttcttcagagaaaatagacttactggccagtgatcctcatgaggctttaat

SEQ ID NO: 714 - DNA, 121 bp, Homo sapiens
attaaagcctcatgaggatcactggccagtaagtctattttctctgaagaaccagaatattcatctacctcatttagaacgtccaatacatcagctactttggcatttgattcagactccc

SEQ ID NO: 715 - DNA, 17 bp, Homo sapiens
ggtagatgaatattctg

SEQ ID NO: 716 - DNA, 17 bp, Homo sapiens
cagaatattcatctacc

SEQ ID NO: 717 - DNA, 121 bp, Homo sapiens
atatgtaaaagtgaaagagttcactccaaatcagtagagagtaatattgaagacaaaatatttgggaaaacctatcggaagaaggcaagcctccccaacttaagccatgtaactgaaaatc

SEQ ID NO: 718 - DNA, 121 bp, Homo sapiens
gattttcagttacatggcttaagttggggaggcttgccttcttccgataggttttcccaaatattttgtcttcaatattactctctactgatttggagtgaactctttcacttttacatat

SEQ ID NO: 719 - DNA, 17 bp, Homo sapiens
acaaaatatttgggaaa

SEQ ID NO: 720 - DNA, 17 bp, Homo sapiens
tttcccaaatattttgt

SEQ ID NO: 721 - DNA, 121 bp, Homo sapiens
gaaagagttcactccaaatcagtagagagtaatattgaagacaaaatatttgggaaaacctatcggaagaaggcaagcctccccaacttaagccatgtaactgaaaatctaattataggag

SEQ ID NO: 722 - DNA, 121 bp, Homo sapiens
ctcctataattagattttcagttacatggcttaagttggggaggcttgccttcttccgataggttttcccaaatattttgtcttcaatattactctctactgatttggagtgaactctttc

SEQ ID NO: 723 - DNA, 17 bp, Homo sapiens
ggaaaacctatcggaag

SEQ ID NO: 724 - DNA, 17 bp, Homo sapiens
cttccgataggttttcc

SEQ ID NO: 725 - DNA, 121 bp, Homo sapiens
acctatcggaagaaggcaagcctccccaacttaagccatgtaactgaaaatctaattataggagcatttgttactgagccacagataatacaagagcgtcccctcacaaataaattaaagc

SEQ ID NO: 726 - DNA, 121 bp, Homo sapiens
gctttaatttatttgtgaggggacgctcttgtattatctgtggctcagtaacaaatgctcctataattagattttcagttacatggcttaagttggggaggcttgccttcttccgataggt

SEQ ID NO: 727 - DNA, 17 bp, Homo sapiens
taattataggagcattt

SEQ ID NO: 728 - DNA, 17 bp, Homo sapiens
aaatgctcctataatta

SEQ ID NO: 729 - DNA, 121 bp, Homo sapiens
ttactgagccacagataatacaagagcgtcccctcacaaataaattaaagcgtaaaaggagacctacatcaggccttcatcctgaggattttatcaagaaagcagatttggcagttcaaaa

SEQ ID NO: 730 - DNA, 121 bp, Homo sapiens
ttttgaactgccaaatctgctttcttgataaaatcctcaggatgaaggcctgatgtaggtctccttttacgctttaatttatttgtgaggggacgctcttgtattatctgtggctcagtaa

SEQ ID NO: 731 - DNA, 17 bp, Homo sapiens
taaaaggagacctacat

SEQ ID NO: 732 - DNA, 17 bp, Homo sapiens
atgtaggtctcctttta

SEQ ID NO: 733 - DNA, 121 bp, Homo sapiens
cacagataatacaagagcgtcccctcacaaataaattaaagcgtaaaaggagacctacatcaggccttcatcctgaggattttatcaagaaagcagatttggcagttcaaaagactcctga

SEQ ID NO: 734 - DNA, 121 bp, Homo sapiens
tcaggagtcttttgaactgccaaatctgctttcttgataaaatcctcaggatgaaggcctgatgtaggtctccttttacgctttaatttatttgtgaggggacgctcttgtattatctgtg

SEQ ID NO: 735 - DNA, 17 bp, Homo sapiens
acctacatcaggccttc

SEQ ID NO: 736 - DNA, 17 bp, Homo sapiens
gaaggcctgatgtaggt

SEQ ID NO: 737 - DNA, 121 bp, Homo sapiens
aggagacctacatcaggccttcatcctgaggattttatcaagaaagcagatttggcagttcaaaagactcctgaaatgataaatcagggaactaaccaaacggagcagaatggtcaagtga

SEQ ID NO: 738 - DNA, 121 bp, Homo sapiens
tcacttgaccattctgctccgtttggttagttccctgatttatcatttcaggagtcttttgaactgccaaatctgctttcttgataaaatcctcaggatgaaggcctgatgtaggtctcct

SEQ ID NO: 739 - DNA, 17 bp, Homo sapiens
tggcagttcaaaagact

SEQ ID NO: 740 - DNA, 17 bp, Homo sapiens
agtcttttgaactgcca

SEQ ID NO: 741 - DNA, 121 bp, Homo sapiens; identical to SEQ ID NO: 737

SEQ ID NO: 742 - DNA, 121 bp, Homo sapiens; identical to SEQ ID NO: 738

SEQ ID NO: 743 - DNA, 17 bp, Homo sapiens
aaacggagcagaatggt

SEQ ID NO: 744 - DNA, 17 bp, Homo sapiens
accattctgctccgttt

SEQ ID NO: 745 - DNA, 121 bp, Homo sapiens
taaatcagggaactaaccaaacggagcagaatggtcaagtgatgaatattactaatagtggtcatgagaataaaacaaaaggtgattctattcagaatgagaaaaatcctaacccaataga

SEQ ID NO: 746 - DNA, 121 bp, Homo sapiens
tctattgggttaggatttttctcattctgaatagaatcaccttttgttttattctcatgaccactattagtaatattcatcacttgaccattctgctccgtttggttagttccctgattta

SEQ ID NO: 747 - DNA, 17 bp, Homo sapiens
taatagtggtcatgaga

SEQ ID NO: 748 - DNA, 17 bp, Homo sapiens
tctcatgaccactatta

SEQ ID NO: 749 - DNA, 121 bp, Homo sapiens
ggtcaagtgatgaatattactaatagtggtcatgagaataaaacaaaaggtgattctattcagaatgagaaaaatcctaacccaatagaatcactcgaaaaagaatctgctttcaaaacga

SEQ ID NO: 750 - DNA, 121 bp, Homo sapiens
tcgttttgaaagcagattctttttcgagtgattctattgggttaggatttttctcattctgaatagaatcaccttttgttttattctcatgaccactattagtaatattcatcacttgacc

SEQ ID NO: 751 - DNA, 17 bp, Homo sapiens
attctattcagaatgag

SEQ ID NO: 752 - DNA, 17 bp, Homo sapiens
ctcattctgaatagaat

SEQ ID NO: 753 - DNA, 121 bp, Homo sapiens
ataagcagcagtataagcaatatggaactcgaattaaatatccacaattcaaaagcacctaaaaagaataggctgaggaggaagtcttctaccaggcatattcatgcgcttgaactagtag

SEQ ID NO: 754 - DNA, 121 bp, Homo sapiens
ctactagttcaagcgcatgaatatgcctggtagaagacttcctcctcagcctattctttttaggtgcttttgaattgtggatatttaattcgagttccatattgcttatactgctgcttat

SEQ ID NO: 755 - DNA, 17 bp, Homo sapiens
aagcacctaaaaagaat

SEQ ID NO: 756 - DNA, 17 bp, Homo sapiens
attctttttaggtgctt

SEQ ID NO: 757 - DNA, 121 bp, Homo sapiens
atattcatgcgcttgaactagtagtcagtagaaatctaagcccacctaattgtactgaattgcaaattgatagttgttctagcagtgaagagataaagaaaaaaaagtacaaccaaatgcc

SEQ ID NO: 758 - DNA, 121 bp, Homo sapiens
ggcatttggttgtacttttttttctttatctcttcactgctagaacaactatcaatttgcaattcagtacaattaggtgggcttagatttctactgactactagttcaagcgcatgaatat

SEQ ID NO: 759 - DNA, 17 bp, Homo sapiens
tactgaattgcaaattg

SEQ ID NO: 760 - DNA, 17 bp, Homo sapiens
caatttgcaattcagta

SEQ ID NO: 761 - DNA, 121 bp, Homo sapiens
gaacctgcaactggagccaagaagagtaacaagccaaatgaacagacaagtaaaagacatgacagcgatactttcccagagctgaagttaacaaatgcacctggttcttttactaagtgtt

SEQ ID NO: 762 - DNA, 121 bp, Homo sapiens
aacacttagtaaaagaaccaggtgcatttgttaacttcagctctgggaaagtatcgctgtcatgtcttttacttgtctgttcatttggcttgttactcttcttggctccagttgcaggttc

SEQ ID NO: 763 - DNA, 17 bp, Homo sapiens
aaagacatgacagcgat

SEQ ID NO: 764 - DNA, 17 bp, Homo sapiens
atcgctgtcatgtcttt

SEQ ID NO: 765 - DNA, 121 bp, Homo sapiens
ctgaagttaacaaatgcacctggttcttttactaagtgttcaaataccagtgaacttaaagaatttgtcaatcctagccttccaagagaagaaaaagaagagaaactagaaacagttaaag

SEQ ID NO: 766 - DNA, 121 bp, Homo sapiens
ctttaactgtttctagtttctcttctttttcttctcttggaaggctaggattgacaaattctttaagttcactggtatttgaacacttagtaaaagaaccaggtgcatttgttaacttcag

SEQ ID NO: 767 - DNA, 17 bp, Homo sapiens
aacttaaagaatttgtc

SEQ ID NO: 768 - DNA, 17 bp, Homo sapiens
gacaaattctttaagtt

SEQ ID NO: 769 - DNA, 121 bp, Homo sapiens
ctagaaacagttaaagtgtctaataatgctgaagaccccaaagatctcatgttaagtggagaaagggttttgcaaactgaaagatctgtagagagtagcagtatttcattggtacctggta

SEQ ID NO: 770 - DNA, 121 bp, Homo sapiens
taccaggtaccaatgaaatactgctactctctacagatctttcagtttgcaaaaccctttctccacttaacatgagatctttggggtcttcagcattattagacactttaactgtttctag

SEQ ID NO: 771 - DNA, 17 bp, Homo sapiens
taagtggagaaagggtt

SEQ ID NO: 772 - DNA, 17 bp, Homo sapiens
aaccctttctccactta

SEQ ID NO: 773 - DNA, 121 bp, Homo sapiens
tcatgttaagtggagaaagggttttgcaaactgaaagatctgtagagagtagcagtatttcattggtacctggtactgattatggcactcaggaaagtatctcgttactggaagttagcac

SEQ ID NO: 774 - DNA, 121 bp, Homo sapiens
gtgctaacttccagtaacgagatactttcctgagtgccataatcagtaccaggtaccaatgaaatactgctactctctacagatctttcagtttgcaaaaccctttctccacttaacatga

SEQ ID NO: 775 - DNA, 17 bp, Homo sapiens
cagtatttcattggtac

SEQ ID NO: 776 - DNA, 17 bp, Homo sapiens
gtaccaatgaaatactg

SEQ ID NO: 777 - DNA, 121 bp, Homo sapiens
taagtggagaaagggttttgcaaactgaaagatctgtagagagtagcagtatttcattggtacctggtactgattatggcactcaggaaagtatctcgttactggaagttagcactctagg

SEQ ID NO: 778 - DNA, 121 bp, Homo sapiens
cctagagtgctaacttccagtaacgagatactttcctgagtgccataatcagtaccaggtaccaatgaaatactgctactctctacagatctttcagtttgcaaaaccctttctccactta

SEQ ID NO: 779 - DNA, 17 bp, Homo sapiens
ttcattggtacctggta

SEQ ID NO: 780 - DNA, 17 bp, Homo sapiens
taccaggtaccaatgaa

SEQ ID NO: 781 - DNA, 121 bp, Homo sapiens
actgaaagatctgtagagagtagcagtatttcattggtacctggtactgattatggcactcaggaaagtatctcgttactggaagttagcactctagggaaggcaaaaacagaaccaaata

SEQ ID NO: 782 - DNA, 121 bp, Homo sapiens
tatttggttctgtttttgccttccctagagtgctaacttccagtaacgagatactttcctgagtgccataatcagtaccaggtaccaatgaaatactgctactctctacagatctttcagt

SEQ ID NO: 783 - DNA, 17 bp, Homo sapiens
atggcactcaggaaagt

SEQ ID NO: 784 - DNA, 17 bp, Homo sapiens
actttcctgagtgccat

SEQ ID NO: 785 - DNA, 121 bp, Homo sapiens
tatggcactcaggaaagtatctcgttactggaagttagcactctagggaaggcaaaaacagaaccaaataaatgtgtgagtcagtgtgcagcatttgaaaaccccaagggactaattcatg

SEQ ID NO: 786 - DNA, 121 bp, Homo sapiens
catgaattagtcccttggggttttcaaatgctgcacactgactcacacatttatttggttctgtttttgccttccctagagtgctaacttccagtaacgagatactttcctgagtgccata

SEQ ID NO: 787 - DNA, 17 bp, Homo sapiens
caaaaacagaaccaaat

SEQ ID NO: 788 - DNA, 17 bp, Homo sapiens
atttggttctgtttttg

SEQ ID NO: 789 - DNA, 121 bp, Homo sapiens
aaatgtgtgagtcagtgtgcagcatttgaaaaccccaagggactaattcatggttgttccaaagataatagaaatgacacagaaggctttaagtatccattgggacatgaagttaaccaca

SEQ ID NO: 790 - DNA, 121 bp, Homo sapiens
tgtggttaacttcatgtcccaatggatacttaaagccttctgtgtcatttctattatctttggaacaaccatgaattagtcccttggggttttcaaatgctgcacactgactcacacattt

SEQ ID NO: 791 - DNA, 17 bp, Homo sapiens
gttgttccaaagataat

SEQ ID NO: 792 - DNA, 17 bp, Homo sapiens
attatctttggaacaac

SEQ ID NO: 793 - DNA, 121 bp, Homo sapiens
cagcatttgaaaaccccaagggactaattcatggttgttccaaagataatagaaatgacacagaaggctttaagtatccattgggacatgaagttaaccacagtcgggaaacaagcataga

SEQ ID NO: 794 - DNA, 121 bp, Homo sapiens
tctatgcttgtttcccgactgtggttaacttcatgtcccaatggatacttaaagccttctgtgtcatttctattatctttggaacaaccatgaattagtcccttggggttttcaaatgctg

SEQ ID NO: 795 - DNA, 17 bp, Homo sapiens
aaatgacacagaaggct

SEQ ID NO: 796 - DNA, 17 bp, Homo sapiens
agccttctgtgtcattt

SEQ ID NO: 797 - DNA, 121 bp, Homo sapiens
gataatagaaatgacacagaaggctttaagtatccattgggacatgaagttaaccacagtcgggaaacaagcatagaaatggaagaaagtgaacttgatgctcagtatttgcagaatacat

SEQ ID NO: 798 - DNA, 121 bp, Homo sapiens
atgtattctgcaaatactgagcatcaagttcactttcttccatttctatgcttgtttcccgactgtggttaacttcatgtcccaatggatacttaaagccttctgtgtcatttctattatc

SEQ ID NO: 799 - DNA, 17 bp, Homo sapiens
accacagtcgggaaaca

SEQ ID NO: 800 - DNA, 17 bp, Homo sapiens
tgtttcccgactgtggt

SEQ ID NO: 801 - DNA, 121 bp, Homo sapiens
aacttgatgctcagtatttgcagaatacattcaaggtttcaaagcgccagtcatttgctccgttttcaaatccaggaaatgcagaagaggaatgtgcaacattctctgcccactctgggtc

SEQ ID NO: 802 - DNA, 121 bp, Homo sapiens
gacccagagtgggcagagaatgttgcacattcctcttctgcatttcctggatttgaaaacggagcaaatgactggcgctttgaaaccttgaatgtattctgcaaatactgagcatcaagtt

SEQ ID NO: 803 - DNA, 17 bp, Homo sapiens
atttgctccgttttcaa

SEQ ID NO: 804 - DNA, 17 bp, Homo sapiens
ttgaaaacggagcaaat

SEQ ID NO: 805 - DNA, 121 bp, Homo sapiens
tttcaaatccaggaaatgcagaagaggaatgtgcaacattctctgcccactctgggtccttaaagaaacaaagtccaaaagtcacttttgaatgtgaacaaaaggaagaaaatcaaggaaa

SEQ ID NO: 806 - DNA, 121 bp, Homo sapiens
tttccttgattttcttccttttgttcacattcaaaagtgacttttggactttgtttctttaaggacccagagtgggcagagaatgttgcacattcctcttctgcatttcctggatttgaaa

SEQ ID NO: 807 - DNA, 17 bp, Homo sapiens
tgggtccttaaagaaac

SEQ ID NO: 808 - DNA, 17 bp, Homo sapiens
gtttctttaaggaccca

SEQ ID NO: 809 - DNA, 121 bp, Homo sapiens
cactctgggtccttaaagaaacaaagtccaaaagtcacttttgaatgtgaacaaaaggaagaaaatcaaggaaagaatgagtctaatatcaagcctgtacagacagttaatatcactgcag

SEQ ID NO: 810 - DNA, 121 bp, Homo sapiens
ctgcagtgatattaactgtctgtacaggcttgatattagactcattctttccttgattttcttccttttgttcacattcaaaagtgacttttggactttgtttctttaaggacccagagtg

SEQ ID NO: 811 - DNA, 17 bp, Homo sapiens
aaaaggaagaaaatcaa

SEQ ID NO: 812 - DNA, 17 bp, Homo sapiens
ttgattttcttcctttt

SEQ ID NO: 813 - DNA, 121 bp, Homo sapiens
ataatgccaaatgtagtatcaaaggaggctctaggttttgtctatcatctcagttcagaggcaacgaaactggactcattactccaaataaacatggacttttacaaaacccatatcgtat

SEQ ID NO: 814 - DNA, 121 bp, Homo sapiens
atacgatatgggttttgtaaaagtccatgtttatttggagtaatgagtccagtttcgttgcctctgaactgagatgatagacaaaacctagagcctcctttgatactacatttggcattat

SEQ ID NO: 815 - DNA, 17 bp, Homo sapiens
gttcagaggcaacgaaa

SEQ ID NO: 816 - DNA, 17 bp, Homo sapiens
tttcgttgcctctgaac

SEQ ID NO: 817 - DNA, 121 bp, Homo sapiens
atttgttaaaactaaatgtaagaaaaatctgctagaggaaaactttgaggaacattcaatgtcacctgaaagagaaatgggaaatgagaacattccaagtacagtgagcacaattagccgt

SEQ ID NO: 818 - DNA, 121 bp, Homo sapiens
acggctaattgtgctcactgtacttggaatgttctcatttcccatttctctttcaggtgacattgaatgttcctcaaagttttcctctagcagatttttcttacatttagttttaacaaat

SEQ ID NO: 819 - DNA, 17 bp, Homo sapiens
cattcaatgtcacctga

SEQ ID NO: 820 - DNA, 17 bp, Homo sapiens
tcaggtgacattgaatg

SEQ ID NO: 821 - DNA, 121 bp, Homo sapiens
actttgaggaacattcaatgtcacctgaaagagaaatgggaaatgagaacattccaagtacagtgagcacaattagccgtaataacattagagaaaatgtttttaaagaagccagctcaag

SEQ ID NO: 822 - DNA, 121 bp, Homo sapiens
cttgagctggcttctttaaaaacattttctctaatgttattacggctaattgtgctcactgtacttggaatgttctcatttcccatttctctttcaggtgacattgaatgttcctcaaagt

SEQ ID NO: 823 - DNA, 17 bp, Homo sapiens
tccaagtacagtgagca

SEQ ID NO: 824 - DNA, 17 bp, Homo sapiens
tgctcactgtacttgga

SEQ ID NO: 825 - DNA, 121 bp, Homo sapiens
acattccaagtacagtgagcacaattagccgtaataacattagagaaaatgtttttaaagaagccagctcaagcaatattaatgaagtaggttccagtactaatgaagtgggctccagtat

SEQ ID NO: 826 - DNA, 121 bp, Homo sapiens
atactggagcccacttcattagtactggaacctacttcattaatattgcttgagctggcttctttaaaaacattttctctaatgttattacggctaattgtgctcactgtacttggaatgt

SEQ ID NO: 827 - DNA, 17 bp, Homo sapiens
ttttaaagaagccagct

SEQ ID NO: 828 - DNA, 17 bp, Homo sapiens
agctggcttctttaaaa

SEQ ID NO: 829 - DNA, 121 bp, Homo sapiens
caagtacagtgagcacaattagccgtaataacattagagaaaatgtttttaaagaagccagctcaagcaatattaatgaagtaggttccagtactaatgaagtgggctccagtattaatga

SEQ ID NO: 830 - DNA, 121 bp, Homo sapiens
tcattaatactggagcccacttcattagtactggaacctacttcattaatattgcttgagctggcttctttaaaaacattttctctaatgttattacggctaattgtgctcactgtacttg

SEQ ID NO: 831 - DNA, 17 bp, Homo sapiens
agaagccagctcaagca

SEQ ID NO: 832 - DNA, 17 bp, Homo sapiens
tgcttgagctggcttct

SEQ ID NO: 833 - DNA, 121 bp, Homo sapiens
gccgtaataacattagagaaaatgtttttaaagaagccagctcaagcaatattaatgaagtaggttccagtactaatgaagtgggctccagtattaatgaaataggttccagtgatgaaaa

SEQ ID NO: 834 - DNA, 121 bp, Homo sapiens
ttttcatcactggaacctatttcattaatactggagcccacttcattagtactggaacctacttcattaatattgcttgagctggcttctttaaaaacattttctctaatgttattacggc

SEQ ID NO: 835 - DNA, 17 bp, Homo sapiens
taatgaagtaggttcca

SEQ ID NO: 836 - DNA, 17 bp, Homo sapiens
tggaacctacttcatta

SEQ ID NO: 837 - DNA, 121 bp, Homo sapiens
aaataggttccagtgatgaaaacattcaagcagaactaggtagaaacagagggccaaaattgaatgctatgcttagattaggggttttgcaacctgaggtctataaacaaagtcttcctgg

SEQ ID NO: 838 - DNA, 121 bp, Homo sapiens
ccaggaagactttgtttatagacctcaggttgcaaaacccctaatctaagcatagcattcaattttggccctctgtttctacctagttctgcttgaatgttttcatcactggaacctattt

SEQ ID NO: 839 - DNA, 17 bp, Homo sapiens
gccaaaattgaatgcta

SEQ ID NO: 840 - DNA, 17 bp, Homo sapiens
tagcattcaattttggc

SEQ ID NO: 841 - DNA, 121 bp, Homo sapiens
aaaacattcaagcagaactaggtagaaacagagggccaaaattgaatgctatgcttagattaggggttttgcaacctgaggtctataaacaaagtcttcctggaagtaattgtaagcatcc

SEQ ID NO: 842 - DNA, 121 bp, Homo sapiens
ggatgcttacaattacttccaggaagactttgtttatagacctcaggttgcaaaacccctaatctaagcatagcattcaattttggccctctgtttctacctagttctgcttgaatgtttt

SEQ ID NO: 843 - DNA, 17 bp, Homo sapiens
gcttagattaggggttt

SEQ ID NO: 844 - DNA, 17 bp, Homo sapiens
aaacccctaatctaagc

SEQ ID NO: 845 - DNA, 121 bp, Homo sapiens
agcaagaatatgaagaagtagttcagactgttaatacagatttctctccatatctgatttcagataacttagaacagcctatgggaagtagtcatgcatctcaggtttgttctgagacacc

SEQ ID NO: 846 - DNA, 121 bp, Homo sapiens
ggtgtctcagaacaaacctgagatgcatgactacttcccataggctgttctaagttatctgaaatcagatatggagagaaatctgtattaacagtctgaactacttcttcatattcttgct

SEQ ID NO: 847 - DNA, 17 bp, Homo sapiens
tctgatttcagataact

SEQ ID NO: 848 - DNA, 17 bp, Homo sapiens
agttatctgaaatcaga

SEQ ID NO: 849 - DNA, 121 bp, Homo sapiens
ctagttttgctgaaaatgacattaaggaaagttctgctgtttttagcaaaagcgtccagaaaggagagcttagcaggagtcctagccctttcacccatacacatttggctcagggttaccg

SEQ ID NO: 850 - DNA, 121 bp, Homo sapiens
cggtaaccctgagccaaatgtgtatgggtgaaagggctaggactcctgctaagctctcctttctggacgcttttgctaaaaacagcagaactttccttaatgtcattttcagcaaaactag

SEQ ID NO: 851 - DNA, 17 bp, Homo sapiens
cgtccagaaaggagagc

SEQ ID NO: 852 - DNA, 17 bp, Homo sapiens
gctctcctttctggacg

SEQ ID NO: 853 - DNA, 121 bp, Homo sapiens
agcgtccagaaaggagagcttagcaggagtcctagccctttcacccatacacatttggctcagggttaccgaagaggggccaagaaattagagtcctcagaagagaacttatctagtgagg

SEQ ID NO: 854 - DNA, 121 bp, Homo sapiens
cctcactagataagttctcttctgaggactctaatttcttggcccctcttcggtaaccctgagccaaatgtgtatgggtgaaagggctaggactcctgctaagctctcctttctggacgct

SEQ ID NO: 855 - DNA, 17 bp, Homo sapiens
atttggctcagggttac

SEQ ID NO: 856 - DNA, 17 bp, Homo sapiens
gtaaccctgagccaaat

SEQ ID NO: 857 - DNA, 121 bp, Homo sapiens
aaaggagagcttagcaggagtcctagccctttcacccatacacatttggctcagggttaccgaagaggggccaagaaattagagtcctcagaagagaacttatctagtgaggatgaagagc

SEQ ID NO: 858 - DNA, 121 bp, Homo sapiens
gctcttcatcctcactagataagttctcttctgaggactctaatttcttggcccctcttcggtaaccctgagccaaatgtgtatgggtgaaagggctaggactcctgctaagctctccttt

SEQ ID NO: 859 - DNA, 17 bp, Homo sapiens
agggttaccgaagaggg

SEQ ID NO: 860 - DNA, 17 bp, Homo sapiens
ccctcttcggtaaccct

SEQ ID NO: 861 - DNA, 121 bp, Homo sapiens
acccatacacatttggctcagggttaccgaagaggggccaagaaattagagtcctcagaagagaacttatctagtgaggatgaagagcttccctgcttccaacacttgttatttggtaaag

SEQ ID NO: 862 - DNA, 121 bp, Homo sapiens
ctttaccaaataacaagtgttggaagcagggaagctcttcatcctcactagataagttctcttctgaggactctaatttcttggcccctcttcggtaaccctgagccaaatgtgtatgggt

SEQ ID NO: 863 - DNA, 17 bp, Homo sapiens
cctcagaagagaactta

SEQ ID NO: 864 - DNA, 17 bp, Homo sapiens
taagttctcttctgagg

SEQ ID NO: 865 - DNA, 121 bp, Homo sapiens
tcagggttaccgaagaggggccaagaaattagagtcctcagaagagaacttatctagtgaggatgaagagcttccctgcttccaacacttgttatttggtaaagtaaacaatataccttct

SEQ ID NO: 866 - DNA, 121 bp, Homo sapiens
agaaggtatattgtttactttaccaaataacaagtgttggaagcagggaagctcttcatcctcactagataagttctcttctgaggactctaatttcttggcccctcttcggtaaccctga

SEQ ID NO: 867 - DNA, 17 bp, Homo sapiens
tctagtgaggatgaaga

SEQ ID NO: 868 - DNA, 17 bp, Homo sapiens
tcttcatcctcactaga

SEQ ID NO: 869 - DNA, 121 bp, Homo sapiens
ggttaccgaagaggggccaagaaattagagtcctcagaagagaacttatctagtgaggatgaagagcttccctgcttccaacacttgttatttggtaaagtaaacaatataccttctcagt

SEQ ID NO: 870 - DNA, 121 bp, Homo sapiens
actgagaaggtatattgtttactttaccaaataacaagtgttggaagcagggaagctcttcatcctcactagataagttctcttctgaggactctaatttcttggcccctcttcggtaacc

SEQ ID NO: 871 - DNA, 17 bp, Homo sapiens
gtgaggatgaagagctt

SEQ ID NO: 872 - DNA, 17 bp, Homo sapiens
aagctcttcatcctcac

SEQ ID NO: 873 - DNA, 121 bp, Homo sapiens
ttatttggtaaagtaaacaatataccttctcagtctactaggcatagcaccgttgctaccgagtgtctgtctaagaacacagaggagaatttattatcattgaagaatagcttaaatgact

SEQ ID NO: 874 - DNA, 121 bp, Homo sapiens
agtcatttaagctattcttcaatgataataaattctcctctgtgttcttagacagacactcggtagcaacggtgctatgcctagtagactgagaaggtatattgtttactttaccaaataa

SEQ ID NO: 875 - DNA, 17 bp, Homo sapiens
ttgctaccgagtgtctg

SEQ ID NO: 876 - DNA, 17 bp, Homo sapiens
cagacactcggtagcaa

SEQ ID NO: 877 - DNA, 121 bp, Homo sapiens
ctaggcatagcaccgttgctaccgagtgtctgtctaagaacacagaggagaatttattatcattgaagaatagcttaaatgactgcagtaaccaggtaatattggcaaaggcatctcagga

SEQ ID NO: 878 - DNA, 121 bp, Homo sapiens
tcctgagatgcctttgccaatattacctggttactgcagtcatttaagctattcttcaatgataataaattctcctctgtgttcttagacagacactcggtagcaacggtgctatgcctag

SEQ ID NO: 879 - DNA, 17 bp, Homo sapiens
tttattatcattgaaga

SEQ ID NO: 880 - DNA, 17 bp, Homo sapiens
tcttcaatgataataaa

SEQ ID NO: 881 - DNA, 121 bp, Homo sapiens
ttatcattgaagaatagcttaaatgactgcagtaaccaggtaatattggcaaaggcatctcaggaacatcaccttagtgaggaaacaaaatgttctgctagcttgttttcttcacagtgca

SEQ ID NO: 882 - DNA, 121 bp, Homo sapiens
tgcactgtgaagaaaacaagctagcagaacattttgtttcctcactaaggtgatgttcctgagatgcctttgccaatattacctggttactgcagtcatttaagctattcttcaatgataa

SEQ ID NO: 883 - DNA, 17 bp, Homo sapiens
aggcatctcaggaacat

SEQ ID NO: 884 - DNA, 17 bp, Homo sapiens
atgttcctgagatgcct

SEQ ID NO: 885 - DNA, 121 bp, Homo sapiens
gctagcttgttttcttcacagtgcagtgaattggaagacttgactgcaaatacaaacacccaggatcctttcttgattggttcttccaaacaaatgaggcatcagtctgaaagccagggag

SEQ ID NO: 886 - DNA, 121 bp, Homo sapiens
ctccctggctttcagactgatgcctcatttgtttggaagaaccaatcaagaaaggatcctgggtgtttgtatttgcagtcaagtcttccaattcactgcactgtgaagaaaacaagctagc

SEQ ID NO: 887 - DNA, 17 bp, Homo sapiens
caaacacccaggatcct

SEQ ID NO: 888 - DNA, 17 bp, Homo sapiens
aggatcctgggtgtttg

SEQ ID NO: 889 - DNA, 121 bp, Homo sapiens
tcacagtgcagtgaattggaagacttgactgcaaatacaaacacccaggatcctttcttgattggttcttccaaacaaatgaggcatcagtctgaaagccagggagttggtctgagtgaca

SEQ ID NO: 890 - DNA, 121 bp, Homo sapiens
tgtcactcagaccaactccctggctttcagactgatgcctcatttgtttggaagaaccaatcaagaaaggatcctgggtgtttgtatttgcagtcaagtcttccaattcactgcactgtga

SEQ ID NO: 891 - DNA, 17 bp, Homo sapiens
ctttcttgattggttct

SEQ ID NO: 892 - DNA, 17 bp, Homo sapiens
agaaccaatcaagaaag

SEQ ID NO: 893 - DNA, 121 bp, Homo sapiens
ttggaagacttgactgcaaatacaaacacccaggatcctttcttgattggttcttccaaacaaatgaggcatcagtctgaaagccagggagttggtctgagtgacaaggaattggtttcag

SEQ ID NO: 894 - DNA, 121 bp, Homo sapiens
ctgaaaccaattccttgtcactcagaccaactccctggctttcagactgatgcctcatttgtttggaagaaccaatcaagaaaggatcctgggtgtttgtatttgcagtcaagtcttccaa

SEQ ID NO: 895 - DNA, 17 bp, Homo sapiens
cttccaaacaaatgagg

SEQ ID NO: 896 - DNA, 17 bp, Homo sapiens
cctcatttgtttggaag

SEQ ID NO: 897 - DNA, 121 bp, Homo sapiens
cagtctgaaagccagggagttggtctgagtgacaaggaattggtttcagatgatgaagaaagaggaacgggcttggaagaaaataatcaagaagagcaaagcatggattcaaacttaggta

SEQ ID NO: 898 - DNA, 121 bp, Homo sapiens
tacctaagtttgaatccatgctttgctcttcttgattattttcttccaagcccgttcctctttcttcatcatctgaaaccaattccttgtcactcagaccaactccctggctttcagactg

SEQ ID NO: 899 - DNA, 17 bp, Homo sapiens
atgaagaaagaggaacg

SEQ ID NO: 900 - DNA, 17 bp, Homo sapiens
cgttcctctttcttcat

SEQ ID NO: 901 - DNA, 121 bp, Homo sapiens
gaaacaagcgtctctgaagactgctcagggctatcctctcagagtgacattttaaccactcaggtaaaaagcgtgtgtgtgtgtgcacatgcgtgtgtgtggtgtcctttgcattcagtag

SEQ ID NO: 902 - DNA, 121 bp, Homo sapiens
ctactgaatgcaaaggacaccacacacacgcatgtgcacacacacacacgctttttacctgagtggttaaaatgtcactctgagaggatagccctgagcagtcttcagagacgcttgtttc

SEQ ID NO: 903 - DNA, 17 bp, Homo sapiens
taaccactcaggtaaaa

SEQ ID NO: 904 - DNA, 17 bp, Homo sapiens
ttttacctgagtggtta

SEQ ID NO: 905 - DNA, 121 bp, Homo sapiens
tggtgccatttatcgtttttgaagcagagggataccatgcaacataacctgataaagctccagcaggaaatggctgaactagaagctgtgttagaacagcatgggagccagccttctaaca

SEQ ID NO: 906 - DNA, 121 bp, Homo sapiens
tgttagaaggctggctcccatgctgttctaacacagcttctagttcagccatttcctgctggagctttatcaggttatgttgcatggtatccctctgcttcaaaaacgataaatggcacca

SEQ ID NO: 907 - DNA, 17 bp, Homo sapiens
taaagctccagcaggaa

SEQ ID NO: 908 - DNA, 17 bp, Homo sapiens
ttcctgctggagcttta

SEQ ID NO: 909 - DNA, 121 bp, Homo sapiens
agccagccttctaacagctacccttccatcataagtgactcttctgcccttgaggacctgcgaaatccagaacaaagcacatcagaaaaaggtgtgtattgttggccaaacactgatatct

SEQ ID NO: 910 - DNA, 121 bp, Homo sapiens
agatatcagtgtttggccaacaatacacacctttttctgatgtgctttgttctggatttcgcaggtcctcaagggcagaagagtcacttatgatggaagggtagctgttagaaggctggct

SEQ ID NO: 911 - DNA, 17 bp, Homo sapiens
aggacctgcgaaatcca

SEQ ID NO: 912 - DNA, 17 bp, Homo sapiens
tggatttcgcaggtcct

SEQ ID NO: 913 - DNA, 121 bp, Homo sapiens
cagaatagaaactacccatctcaagaggagctcattaaggttgttgatgtggaggagcaacagctggaagagtctgggccacacgatttgacggaaacatcttacttgccaaggcaagatc

SEQ ID NO: 914 - DNA, 121 bp, Homo sapiens
gatcttgccttggcaagtaagatgtttccgtcaaatcgtgtggcccagactcttccagctgttgctcctccacatcaacaaccttaatgagctcctcttgagatgggtagtttctattctg

SEQ ID NO: 915 - DNA, 17 bp, Homo sapiens
aggagcaacagctggaa

SEQ ID NO: 916 - DNA, 17 bp, Homo sapiens
ttccagctgttgctcct

SEQ ID NO: 917 - DNA, 121 bp, Homo sapiens
atctttctaggtcatccccttctaaatgcccatcattagatgataggtggtacatgcacagttgctctgggagtcttcagaatagaaactacccatctcaagaggagctcattaaggttgt

SEQ ID NO: 918 - DNA, 121 bp, Homo sapiens
acaaccttaatgagctcctcttgagatgggtagtttctattctgaagactcccagagcaactgtgcatgtaccacctatcatctaatgatgggcatttagaaggggatgacctagaaagat

SEQ ID NO: 919 - DNA, 17 bp, Homo sapiens
catgcacagttgctctg

SEQ ID NO: 920 - DNA, 17 bp, Homo sapiens
cagagcaactgtgcatg

SEQ ID NO: 921 - DNA, 121 bp, Homo sapiens; identical to SEQ ID NO: 913

SEQ ID NO: 922 - DNA, 121 bp, Homo sapiens; identical to SEQ ID NO: 914

SEQ ID NO: 923 - DNA, 17 bp, Homo sapiens
aggagcaacagctggaa

SEQ ID NO: 924 - DNA, 17 bp, Homo sapiens
ttccagctgttgctcct

SEQ ID NO: 925 - DNA, 121 bp, Homo sapiens
aactacccatctcaagaggagctcattaaggttgttgatgtggaggagcaacagctggaagagtctgggccacacgatttgacggaaacatcttacttgccaaggcaagatctaggtaata

SEQ ID NO: 926 - DNA, 121 bp, Homo sapiens
tattacctagatcttgccttggcaagtaagatgtttccgtcaaatcgtgtggcccagactcttccagctgttgctcctccacatcaacaaccttaatgagctcctcttgagatgggtagtt

SEQ ID NO: 927 - DNA, 17 bp, Homo sapiens
agctggaagagtctggg

SEQ ID NO: 928 - DNA, 17 bp, Homo sapiens
cccagactcttccagct

SEQ ID NO: 929 - DNA, 121 bp, Homo sapiens
tttgtaattcaacattcatcgttgtgtaaattaaacttctcccattcctttcagagggaaccccttacctggaatctggaatcagcctcttctctgatgaccctgaatctgatccttctga

SEQ ID NO: 930 - DNA, 121 bp, Homo sapiens
tcagaaggatcagattcagggtcatcagagaagaggctgattccagattccaggtaaggggttccctctgaaaggaatgggagaagtttaatttacacaacgatgaatgttgaattacaaa

SEQ ID NO: 931 - DNA, 17 bp, Homo sapiens
agagggaaccccttacc

SEQ ID NO: 932 - DNA, 17 bp, Homo sapiens
ggtaaggggttccctct

SEQ ID NO: 933 - DNA, 121 bp, Homo sapiens
caacattcatcgttgtgtaaattaaacttctcccattcctttcagagggaaccccttacctggaatctggaatcagcctcttctctgatgaccctgaatctgatccttctgaagacagagc

SEQ ID NO: 934 - DNA, 121 bp, Homo sapiens
gctctgtcttcagaaggatcagattcagggtcatcagagaagaggctgattccagattccaggtaaggggttccctctgaaaggaatgggagaagtttaatttacacaacgatgaatgttg

SEQ ID NO: 935 - DNA, 17 bp, Homo sapiens
cccttacctggaatctg

SEQ ID NO: 936 - DNA, 17 bp, Homo sapiens
cagattccaggtaaggg

SEQ ID NO: 937 - DNA, 121 bp, Homo sapiens
gccccagagtcagctcgtgttggcaacataccatcttcaacctctgcattgaaagttccccaattgaaagttgcagaatctgcccagagtccagctgctgctcatactactgatactgctg

SEQ ID NO: 938 - DNA, 121 bp, Homo sapiens
cagcagtatcagtagtatgagcagcagctggactctgggcagattctgcaactttcaattggggaactttcaatgcagaggttgaagatggtatgttgccaacacgagctgactctggggc

SEQ ID NO: 939 - DNA, 17 bp, Homo sapiens
aagttccccaattgaaa

SEQ ID NO: 940 - DNA, 17 bp, Homo sapiens
tttcaattggggaactt

SEQ ID NO: 941 - DNA, 121 bp, Homo sapiens
gagtcagctcgtgttggcaacataccatcttcaacctctgcattgaaagttccccaattgaaagttgcagaatctgcccagagtccagctgctgctcatactactgatactgctgggtata

SEQ ID NO: 942 - DNA, 121 bp, Homo sapiens
tatacccagcagtatcagtagtatgagcagcagctggactctgggcagattctgcaactttcaattggggaactttcaatgcagaggttgaagatggtatgttgccaacacgagctgactc

SEQ ID NO: 943 - DNA, 17 bp, Homo sapiens
cccaattgaaagttgca

SEQ ID NO: 944 - DNA, 17 bp, Homo sapiens
tgcaactttcaattggg

SEQ ID NO: 945 - DNA, 121 bp, Homo sapiens
cagaatctgcccagagtccagctgctgctcatactactgatactgctgggtataatgcaatggaagaaagtgtgagcagggagaagccagaattgacagcttcaacagaaagggtcaacaa

SEQ ID NO: 946 - DNA, 121 bp, Homo sapiens
ttgttgaccctttctgttgaagctgtcaattctggcttctccctgctcacactttcttccattgcattatacccagcagtatcagtagtatgagcagcagctggactctgggcagattctg

SEQ ID NO: 947 - DNA, 17 bp, Homo sapiens
taatgcaatggaagaaa

SEQ ID NO: 948 - DNA, 17 bp, Homo sapiens
tttcttccattgcatta

SEQ ID NO: 949 - DNA, 121 bp, Homo sapiens
gcagaatctgcccagagtccagctgctgctcatactactgatactgctgggtataatgcaatggaagaaagtgtgagcagggagaagccagaattgacagcttcaacagaaagggtcaaca

SEQ ID NO: 950 - DNA, 121 bp, Homo sapiens
tgttgaccctttctgttgaagctgtcaattctggcttctccctgctcacactttcttccattgcattatacccagcagtatcagtagtatgagcagcagctggactctgggcagattctgc

SEQ ID NO: 951 - DNA, 17 bp, Homo sapiens
ataatgcaatggaagaa

SEQ ID NO: 952 - DNA, 17 bp, Homo sapiens
ttcttccattgcattat

SEQ ID NO: 953 - DNA, 121 bp, Homo sapiens
ctcatactactgatactgctgggtataatgcaatggaagaaagtgtgagcagggagaagccagaattgacagcttcaacagaaagggtcaacaaaagaatgtccatggtggtgtctggcct

SEQ ID NO: 954 - DNA, 121 bp, Homo sapiens
aggccagacaccaccatggacattcttttgttgaccctttctgttgaagctgtcaattctggcttctccctgctcacactttcttccattgcattatacccagcagtatcagtagtatgag

SEQ ID NO: 955 - DNA, 17 bp, Homo sapiens
ggagaagccagaattga

SEQ ID NO: 956 - DNA, 17 bp, Homo sapiens
tcaattctggcttctcc

SEQ ID NO: 957 - DNA, 121 bp, Homo sapiens
gagcagggagaagccagaattgacagcttcaacagaaagggtcaacaaaagaatgtccatggtggtgtctggcctgaccccagaagaatttgtgagtgtatccatatgtatctccctaatg

SEQ ID NO: 958 - DNA, 121 bp, Homo sapiens
cattagggagatacatatggatacactcacaaattcttctggggtcaggccagacaccaccatggacattcttttgttgaccctttctgttgaagctgtcaattctggcttctccctgctc

SEQ ID NO: 959 - DNA, 17 bp, Homo sapiens
atgtccatggtggtgtc

SEQ ID NO: 960 - DNA, 17 bp, Homo sapiens
gacaccaccatggacat

SEQ ID NO: 961 - DNA, 121 bp, Homo sapiens
cacttcctgattttgttttcaacttctaatcctttgagtgtttttcattctgcagatgctgagtttgtgtgtgaacggacactgaaatattttctaggaattgcgggaggaaaatgggtag

SEQ ID NO: 962 - DNA, 121 bp, Homo sapiens
ctacccattttcctcccgcaattcctagaaaatatttcagtgtccgttcacacacaaactcagcatctgcagaatgaaaaacactcaaaggattagaagttgaaaacaaaatcaggaagtg

SEQ ID NO: 963 - DNA, 17 bp, Homo sapiens
cagatgctgagtttgtg

SEQ ID NO: 964 - DNA, 17 bp, Homo sapiens
cacaaactcagcatctg

SEQ ID NO: 965 - DNA, 121 bp, Homo sapiens
gtgtttttcattctgcagatgctgagtttgtgtgtgaacggacactgaaatattttctaggaattgcgggaggaaaatgggtagttagctatttctgtaagtataatactatttctcccct

SEQ ID NO: 966 - DNA, 121 bp, Homo sapiens
aggggagaaatagtattatacttacagaaatagctaactacccattttcctcccgcaattcctagaaaatatttcagtgtccgttcacacacaaactcagcatctgcagaatgaaaaacac

SEQ ID NO: 967 - DNA, 17 bp, Homo sapiens
ttttctaggaattgcgg

SEQ ID NO: 968 - DNA, 17 bp, Homo sapiens
ccgcaattcctagaaaa

SEQ ID NO: 969 - DNA, 121 bp, Homo sapiens
ttcattctgcagatgctgagtttgtgtgtgaacggacactgaaatattttctaggaattgcgggaggaaaatgggtagttagctatttctgtaagtataatactatttctcccctcctccc

SEQ ID NO: 970 - DNA, 121 bp, Homo sapiens
gggaggaggggagaaatagtattatacttacagaaatagctaactacccattttcctcccgcaattcctagaaaatatttcagtgtccgttcacacacaaactcagcatctgcagaatgaa

SEQ ID NO: 971 - DNA, 17 bp, Homo sapiens
aggaattgcgggaggaa

SEQ ID NO: 972 - DNA, 17 bp, Homo sapiens
ttcctcccgcaattcct

SEQ ID NO: 973 - DNA, 121 bp, Homo sapiens
ctgagtttgtgtgtgaacggacactgaaatattttctaggaattgcgggaggaaaatgggtagttagctatttctgtaagtataatactatttctcccctcctccctttaacacctcagaa

SEQ ID NO: 974 - DNA, 121 bp, Homo sapiens
ttctgaggtgttaaagggaggaggggagaaatagtattatacttacagaaatagctaactacccattttcctcccgcaattcctagaaaatatttcagtgtccgttcacacacaaactcag

SEQ ID NO: 975 - DNA, 17 bp, Homo sapiens
aaaatgggtagttagct

SEQ ID NO: 976 - DNA, 17 bp, Homo sapiens
agctaactacccatttt

SEQ ID NO: 977 - DNA, 121 bp, Homo sapiens
aacggacactgaaatattttctaggaattgcgggaggaaaatgggtagttagctatttctgtaagtataatactatttctcccctcctccctttaacacctcagaattgcatttttacacc

SEQ ID NO: 978 - DNA, 121 bp, Homo sapiens
ggtgtaaaaatgcaattctgaggtgttaaagggaggaggggagaaatagtattatacttacagaaatagctaactacccattttcctcccgcaattcctagaaaatatttcagtgtccgtt

SEQ ID NO: 979 - DNA, 17 bp, Homo sapiens
ctatttctgtaagtata

SEQ ID NO: 980 - DNA, 17 bp, Homo sapiens
tatacttacagaaatag

SEQ ID NO: 981 - DNA, 121 bp, Homo sapiens
ttctgctgtatgtaacctgtcttttctatgatctctttaggggtgacccagtctattaaagaaagaaaaatgctgaatgaggtaagtacttgatgttacaaactaaccagagatattcatt

SEQ ID NO: 982 - DNA, 121 bp, Homo sapiens
aatgaatatctctggttagtttgtaacatcaagtacttacctcattcagcatttttctttctttaatagactgggtcacccctaaagagatcatagaaaagacaggttacatacagcagaa

SEQ ID NO: 983 - DNA, 17 bp, Homo sapiens
ctattaaagaaagaaaa

SEQ ID NO: 984 - DNA, 17 bp, Homo sapiens
ttttctttctttaatag

SEQ ID NO: 985 - DNA, 121 bp, Homo sapiens
tgtatgtaacctgtcttttctatgatctctttaggggtgacccagtctattaaagaaagaaaaatgctgaatgaggtaagtacttgatgttacaaactaaccagagatattcattcagtca

SEQ ID NO: 986 - DNA, 121 bp, Homo sapiens
tgactgaatgaatatctctggttagtttgtaacatcaagtacttacctcattcagcatttttctttctttaatagactgggtcacccctaaagagatcatagaaaagacaggttacataca

SEQ ID NO: 987 - DNA, 17 bp, Homo sapiens
aagaaagaaaaatgctg

SEQ ID NO: 988 - DNA, 17 bp, Homo sapiens
cagcatttttctttctt

SEQ ID NO: 989 - DNA, 121 bp, Homo sapiens
tctttcagcatgattttgaagtcagaggagatgtggtcaatggaagaaaccaccaaggtccaaagcgagcaagagaatcccaggacagaaaggtaaagctccctccctcaagttgacaaaa

SEQ ID NO: 990 - DNA, 121 bp, Homo sapiens
ttttgtcaacttgagggagggagctttacctttctgtcctgggattctcttgctcgctttggaccttggtggtttcttccattgaccacatctcctctgacttcaaaatcatgctgaaaga

SEQ ID NO: 991 - DNA, 17 bp, Homo sapiens
ccaaggtccaaagcgag

SEQ ID NO: 992 - DNA, 17 bp, Homo sapiens
ctcgctttggaccttgg

SEQ ID NO: 993 - DNA, 121 bp, Homo sapiens
cagcatgattttgaagtcagaggagatgtggtcaatggaagaaaccaccaaggtccaaagcgagcaagagaatcccaggacagaaaggtaaagctccctccctcaagttgacaaaaatctc

SEQ ID NO: 994 - DNA, 121 bp, Homo sapiens
gagatttttgtcaacttgagggagggagctttacctttctgtcctgggattctcttgctcgctttggaccttggtggtttcttccattgaccacatctcctctgacttcaaaatcatgctg

SEQ ID NO: 995 - DNA, 17 bp, Homo sapiens
gtccaaagcgagcaaga

SEQ ID NO: 996 - DNA, 17 bp, Homo sapiens
tcttgctcgctttggac

SEQ ID NO: 997 - DNA, 121 bp, Homo sapiens
gtcagaggagatgtggtcaatggaagaaaccaccaaggtccaaagcgagcaagagaatcccaggacagaaaggtaaagctccctccctcaagttgacaaaaatctcaccccaccactctgt

SEQ ID NO: 998 - DNA, 121 bp, Homo sapiens
acagagtggtggggtgagatttttgtcaacttgagggagggagctttacctttctgtcctgggattctcttgctcgctttggaccttggtggtttcttccattgaccacatctcctctgac

SEQ ID NO: 999 - DNA, 17 bp, Homo sapiens
gagaatcccaggacaga

SEQ ID NO: 1000 - DNA, 17 bp, Homo sapiens
tctgtcctgggattctc

SEQ ID NO: 1001 - DNA, 121 bp, Homo sapiens
ctctcttcttccagatcttcagggggctagaaatctgttgctatgggcccttcaccaacatgcccacaggtaagagcctgggagaaccccagagttccagcaccagcctttgtcttacata

SEQ ID NO: 1002 - DNA, 121 bp, Homo sapiens
tatgtaagacaaaggctggtgctggaactctggggttctcccaggctcttacctgtgggcatgttggtgaagggcccatagcaacagatttctagccccctgaagatctggaagaagagag

SEQ ID NO: 1003 - DNA, 17 bp, Homo sapiens
caccaacatgcccacag

SEQ ID NO: 1004 - DNA, 17 bp, Homo sapiens
ctgtgggcatgttggtg

SEQ ID NO: 1005 - DNA, 121 bp, Homo sapiens
agtatgcagattactgcagtgattttacatctaaatgtccattttagatcaactggaatggatggtacagctgtgtggtgcttctgtggtgaaggagctttcatcattcacccttggcaca

SEQ ID NO: 1006 - DNA, 121 bp, Homo sapiens
tgtgccaagggtgaatgatgaaagctccttcaccacagaagcaccacacagctgtaccatccattccagttgatctaaaatggacatttagatgtaaaatcactgcagtaatctgcatact

SEQ ID NO: 1007 - DNA, 17 bp, Homo sapiens
ctggaatggatggtaca

SEQ ID NO: 1008 - DNA, 17 bp, Homo sapiens
tgtaccatccattccag

SEQ ID NO: 1009 - DNA, 121 bp, Homo sapiens
attactgcagtgattttacatctaaatgtccattttagatcaactggaatggatggtacagctgtgtggtgcttctgtggtgaaggagctttcatcattcacccttggcacagtaagtatt

SEQ ID NO: 1010 - DNA, 121 bp, Homo sapiens
aatacttactgtgccaagggtgaatgatgaaagctccttcaccacagaagcaccacacagctgtaccatccattccagttgatctaaaatggacatttagatgtaaaatcactgcagtaat

SEQ ID NO: 1011 - DNA, 17 bp, Homo sapiens
atggtacagctgtgtgg

SEQ ID NO: 1012 - DNA, 17 bp, Homo sapiens
ccacacagctgtaccat

SEQ ID NO: 1013 - DNA, 121 bp, Homo sapiens
gtccattttagatcaactggaatggatggtacagctgtgtggtgcttctgtggtgaaggagctttcatcattcacccttggcacagtaagtattgggtgccctgtcagagagggaggacac

SEQ ID NO: 1014 - DNA, 121 bp, Homo sapiens
gtgtcctccctctctgacagggcacccaatacttactgtgccaagggtgaatgatgaaagctccttcaccacagaagcaccacacagctgtaccatccattccagttgatctaaaatggac

SEQ ID NO: 1015 - DNA, 17 bp, Homo sapiens
gtgaaggagctttcatc

SEQ ID NO: 1016 - DNA, 17 bp, Homo sapiens
gatgaaagctccttcac

SEQ ID NO: 1017 - DNA, 121 bp, Homo sapiens
ctctgcttgtgttctctgtctccagcaattgggcagatgtgtgaggcacctgtggtgacccgagagtgggtgttggacagtgtagcactctaccagtgccaggagctggacacctacctga

SEQ ID NO: 1018 - DNA, 121 bp, Homo sapiens
tcaggtaggtgtccagctcctggcactggtagagtgctacactgtccaacacccactctcgggtcaccacaggtgcctcacacatctgcccaattgctggagacagagaacacaagcagag

SEQ ID NO: 1019 - DNA, 17 bp, Homo sapiens
tggtgacccgagagtgg

SEQ ID NO: 1020 - DNA, 17 bp, Homo sapiens
ccactctcgggtcacca

SEQ ID NO: 1021 - DNA, 121 bp, Homo sapiens
ttgtgttctctgtctccagcaattgggcagatgtgtgaggcacctgtggtgacccgagagtgggtgttggacagtgtagcactctaccagtgccaggagctggacacctacctgatacccc

SEQ ID NO: 1022 - DNA, 121 bp, Homo sapiens
ggggtatcaggtaggtgtccagctcctggcactggtagagtgctacactgtccaacacccactctcgggtcaccacaggtgcctcacacatctgcccaattgctggagacagagaacacaa

SEQ ID NO: 1023 - DNA, 17 bp, Homo sapiens
cccgagagtgggtgttg

SEQ ID NO: 1024 - DNA, 17 bp, Homo sapiens
caacacccactctcggg

SEQ ID NO: 1025 - DNA, 121 bp, Homo sapiens
tgtgttctctgtctccagcaattgggcagatgtgtgaggcacctgtggtgacccgagagtgggtgttggacagtgtagcactctaccagtgccaggagctggacacctacctgatacccca

SEQ ID NO: 1026 - DNA, 121 bp, Homo sapiens
tggggtatcaggtaggtgtccagctcctggcactggtagagtgctacactgtccaacacccactctcgggtcaccacaggtgcctcacacatctgcccaattgctggagacagagaacaca

SEQ ID NO: 1027 - DNA, 17 bp, Homo sapiens
ccgagagtgggtgttgg

SEQ ID NO: 1028 - DNA, 17 bp, Homo sapiens
ccaacacccactctcgg

SEQ ID NO: 1029 - DNA, 121 bp, Homo sapiens
gttaaaactaaggtgggattttttttttaaatagatttaggaccaataagtcttaattggtttgaagaactttcttcagaagctccaccctataattctgaacctgcagaagaatctgaac

SEQ ID NO: 1030 - DNA, 121 bp, Homo sapiens
gttcagattcttctgcaggttcagaattatagggtggagcttctgaagaaagttcttcaaaccaattaagacttattggtcctaaatctatttaaaaaaaaaatcccaccttagttttaac

SEQ ID NO: 1031 - DNA, 17 bp, Homo sapiens
ttaattggtttgaagaa

SEQ ID NO: 1032 - DNA, 17 bp, Homo sapiens
ttcttcaaaccaattaa

SEQ ID NO: 1033 - DNA, 121 bp, Homo sapiens
tagatttaggaccaataagtcttaattggtttgaagaactttcttcagaagctccaccctataattctgaacctgcagaagaatctgaacataaaaacaacaattacgaaccaaacctatt

SEQ ID NO: 1034 - DNA, 121 bp, Homo sapiens
aataggtttggttcgtaattgttgtttttatgttcagattcttctgcaggttcagaattatagggtggagcttctgaagaaagttcttcaaaccaattaagacttattggtcctaaatcta

SEQ ID NO: 1035 - DNA, 17 bp, Homo sapiens
tccaccctataattctg

SEQ ID NO: 1036 - DNA, 17 bp, Homo sapiens
cagaattatagggtgga

SEQ ID NO: 1037 - DNA, 121 bp, Homo sapiens
aagaactttcttcagaagctccaccctataattctgaacctgcagaagaatctgaacataaaaacaacaattacgaaccaaacctatttaaaactccacaaaggaaaccatcttataatca

SEQ ID NO: 1038 - DNA, 121 bp, Homo sapiens
tgattataagatggtttcctttgtggagttttaaataggtttggttcgtaattgttgtttttatgttcagattcttctgcaggttcagaattatagggtggagcttctgaagaaagttctt

SEQ ID NO: 1039 - DNA, 17 bp, Homo sapiens
tgaacataaaaacaaca

SEQ ID NO: 1040 - DNA, 17 bp, Homo sapiens
tgttgtttttatgttca

SEQ ID NO: 1041 - DNA, 121 bp, Homo sapiens
ctatttaaaactccacaaaggaaaccatcttataatcagctggcttcaactccaataatattcaaagagcaagggctgactctgccgctgtaccaatctcctgtaaaagaattagataaat

SEQ ID NO: 1042 - DNA, 121 bp, Homo sapiens
atttatctaattcttttacaggagattggtacagcggcagagtcagcccttgctctttgaatattattggagttgaagccagctgattataagatggtttcctttgtggagttttaaatag

SEQ ID NO: 1043 - DNA, 17 bp, Homo sapiens
caataatattcaaagag

SEQ ID NO: 1044 - DNA, 17 bp, Homo sapiens
ctctttgaatattattg

SEQ ID NO: 1045 - DNA, 121 bp, Homo sapiens
gtcagacaccaaaacatatttctgaaagtctaggagctgaggtggatcctgatatgtcttggtcaagttctttagctacaccacccacccttagttctactgtgctcataggtaataatag

SEQ ID NO: 1046 - DNA, 121 bp, Homo sapiens
ctattattacctatgagcacagtagaactaagggtgggtggtgtagctaaagaacttgaccaagacatatcaggatccacctcagctcctagactttcagaaatatgttttggtgtctgac

SEQ ID NO: 1047 - DNA, 17 bp, Homo sapiens
tatgtcttggtcaagtt

SEQ ID NO: 1048 - DNA, 17 bp, Homo sapiens
aacttgaccaagacata

SEQ ID NO: 1049 - DNA, 121 bp, Homo sapiens
ctgaaagtctaggagctgaggtggatcctgatatgtcttggtcaagttctttagctacaccacccacccttagttctactgtgctcataggtaataatagcaaatgtgtatttacaagaaa

SEQ ID NO: 1050 - DNA, 121 bp, Homo sapiens
tttcttgtaaatacacatttgctattattacctatgagcacagtagaactaagggtgggtggtgtagctaaagaacttgaccaagacatatcaggatccacctcagctcctagactttcag

SEQ ID NO: 1051 - DNA, 17 bp, Homo sapiens
agctacaccacccaccc

SEQ ID NO: 1052 - DNA, 17 bp, Homo sapiens
gggtgggtggtgtagct

SEQ ID NO: 1053 - DNA, 121 bp, Homo sapiens
acaatacacataaatttttatcttacagtcagaaatgaagaagcatctgaaactgtatttcctcatgatactactgctgtaagtaaatatgacattgattagactgttgaaattgctaaca

SEQ ID NO: 1054 - DNA, 121 bp, Homo sapiens
tgttagcaatttcaacagtctaatcaatgtcatatttacttacagcagtagtatcatgaggaaatacagtttcagatgcttcttcatttctgactgtaagataaaaatttatgtgtattgt

SEQ ID NO: 1055 - DNA, 17 bp, Homo sapiens
ctgtatttcctcatgat

SEQ ID NO: 1056 - DNA, 17 bp, Homo sapiens
atcatgaggaaatacag

SEQ ID NO: 1057 - DNA, 121 bp, Homo sapiens
aatggtctcaactaaccctttcaggtctaaatggagcccagatggagaaaatacccctattgcatatttcttcatgtgaccaaaatatttcagaaaaagacctattagacacagagaacaa

SEQ ID NO: 1058 - DNA, 121 bp, Homo sapiens
ttgttctctgtgtctaataggtctttttctgaaatattttggtcacatgaagaaatatgcaataggggtattttctccatctgggctccatttagacctgaaagggttagttgagaccatt

SEQ ID NO: 1059 - DNA, 17 bp, Homo sapiens
acccctattgcatattt

SEQ ID NO: 1060 - DNA, 17 bp, Homo sapiens
aaatatgcaataggggt

SEQ ID NO: 1061 - DNA, 121 bp, Homo sapiens
agcctctgaaagtggactggaaatacatactgtttgctcacagaaggaggactccttatgtccaaatttaattgataatggaagctggccagccaccaccacacagaattctgtagctttg

SEQ ID NO: 1062 - DNA, 121 bp, Homo sapiens
caaagctacagaattctgtgtggtggtggctggccagcttccattatcaattaaatttggacataaggagtcctccttctgtgagcaaacagtatgtatttccagtccactttcagaggct

SEQ ID NO: 1063 - DNA, 17 bp, Homo sapiens
tccttatgtccaaattt

SEQ ID NO: 1064 - DNA, 17 bp, Homo sapiens
aaatttggacataagga

SEQ ID NO: 1065 - DNA, 121 bp, Homo sapiens
aactctaccatggttttatatggagacacaggtgataaacaagcaacccaagtgtcaattaaaaaagatttggtttatgttcttgcagaggagaacaaaaatagtgtaaagcagcatataa

SEQ ID NO: 1066 - DNA, 121 bp, Homo sapiens
ttatatgctgctttacactatttttgttctcctctgcaagaacataaaccaaatcttttttaattgacacttgggttgcttgtttatcacctgtgtctccatataaaaccatggtagagtt

SEQ ID NO: 1067 - DNA, 17 bp, Homo sapiens
tgtcaattaaaaaagat

SEQ ID NO: 1068 - DNA, 17 bp, Homo sapiens
atcttttttaattgaca

SEQ ID NO: 1069 - DNA, 121 bp, Homo sapiens
atgactactggcacttttgttgaagaaattactgaaaattacaagagaaatactgaaaatgaagataacaaatatactgctgccagtagaaattctcataacttagaatttgatggcagtg

SEQ ID NO: 1070 - DNA, 121 bp, Homo sapiens
cactgccatcaaattctaagttatgagaatttctactggcagcagtatatttgttatcttcattttcagtatttctcttgtaattttcagtaatttcttcaacaaaagtgccagtagtcat

SEQ ID NO: 1071 - DNA, 17 bp, Homo sapiens
ctgaaaatgaagataac

SEQ ID NO: 1072 - DNA, 17 bp, Homo sapiens
gttatcttcattttcag

SEQ ID NO: 1073 - DNA, 121 bp, Homo sapiens
catgaaacaattaaaaaagtgaaagacatatttacagacagtttcagtaaagtaattaaggaaaacaacgagaataaatcaaaaatttgccaaacgaaaattatggcaggttgttacgagg

SEQ ID NO: 1074 - DNA, 121 bp, Homo sapiens
cctcgtaacaacctgccataattttcgtttggcaaatttttgatttattctcgttgttttccttaattactttactgaaactgtctgtaaatatgtctttcacttttttaattgtttcatg

SEQ ID NO: 1075 - DNA, 17 bp, Homo sapiens
taattaaggaaaacaac

SEQ ID NO: 1076 - DNA, 17 bp, Homo sapiens
gttgttttccttaatta

SEQ ID NO: 1077 - DNA, 121 bp, Homo sapiens
tgaaagacatatttacagacagtttcagtaaagtaattaaggaaaacaacgagaataaatcaaaaatttgccaaacgaaaattatggcaggttgttacgaggcattggatgattcagagga

SEQ ID NO: 1078 - DNA, 121 bp, Homo sapiens
tcctctgaatcatccaatgcctcgtaacaacctgccataattttcgtttggcaaatttttgatttattctcgttgttttccttaattactttactgaaactgtctgtaaatatgtctttca

SEQ ID NO: 1079 - DNA, 17 bp, Homo sapiens
gaataaatcaaaaattt

SEQ ID NO: 1080 - DNA, 17 bp, Homo sapiens
aaatttttgatttattc

SEQ ID NO: 1081 - DNA, 121 bp, Homo sapiens
aaccaaaatatgtctggattggagaaagtttctaaaatatcaccttgtgatgttagtttggaaacttcagatatatgtaaatgtagtatagggaagcttcataagtcagtctcatctgcaa

SEQ ID NO: 1082 - DNA, 121 bp, Homo sapiens
ttgcagatgagactgacttatgaagcttccctatactacatttacatatatctgaagtttccaaactaacatcacaaggtgatattttagaaactttctccaatccagacatattttggtt

SEQ ID NO: 1083 - DNA, 17 bp, Homo sapiens
ttagtttggaaacttca

SEQ ID NO: 1084 - DNA, 17 bp, Homo sapiens
tgaagtttccaaactaa

SEQ ID NO: 1085 - DNA, 121 bp, Homo sapiens
ttagtttggaaacttcagatatatgtaaatgtagtatagggaagcttcataagtcagtctcatctgcaaatacttgtgggatttttagcacagcaagtggaaaatctgtccaggtatcaga

SEQ ID NO: 1086 - DNA, 121 bp, Homo sapiens
tctgatacctggacagattttccacttgctgtgctaaaaatcccacaagtatttgcagatgagactgacttatgaagcttccctatactacatttacatatatctgaagtttccaaactaa

SEQ ID NO: 1087 - DNA, 17 bp, Homo sapiens
gtcagtctcatctgcaa

SEQ ID NO: 1088 - DNA, 17 bp, Homo sapiens
ttgcagatgagactgac

SEQ ID NO: 1089 - DNA, 121 bp, Homo sapiens
aagtcagtctcatctgcaaatacttgtgggatttttagcacagcaagtggaaaatctgtccaggtatcagatgcttcattacaaaacgcaagacaagtgttttctgaaatagaagatagta

SEQ ID NO: 1090 - DNA, 121 bp, Homo sapiens
tactatcttctatttcagaaaacacttgtcttgcgttttgtaatgaagcatctgatacctggacagattttccacttgctgtgctaaaaatcccacaagtatttgcagatgagactgactt

SEQ ID NO: 1091 - DNA, 17 bp, Homo sapiens
aatctgtccaggtatca

SEQ ID NO: 1092 - DNA, 17 bp, Homo sapiens
tgatacctggacagatt

SEQ ID NO: 1093 - DNA, 121 bp, Homo sapiens
aaaataagattaatgacaatgagattcatcagtttaacaaaaacaactccaatcaagcagcagctgtaactttcacaaagtgtgaagaagaacctttaggtattgtatgacaatttgtgtg

SEQ ID NO: 1094 - DNA, 121 bp, Homo sapiens
cacacaaattgtcatacaatacctaaaggttcttcttcacactttgtgaaagttacagctgctgcttgattggagttgtttttgttaaactgatgaatctcattgtcattaatcttatttt

SEQ ID NO: 1095 - DNA, 17 bp, Homo sapiens
tcaagcagcagctgtaa

SEQ ID NO: 1096 - DNA, 17 bp, Homo sapiens
ttacagctgctgcttga

SEQ ID NO: 1097 - DNA, 121 bp, Homo sapiens
aggcaacgcgtctttccacagccaggcagtctgtatcttgcaaaaacatccactctgcctcgaatctctctgaaagcagcagtaggaggccaagtcccctctgcgtgtcctcataaacagg

SEQ ID NO: 1098 - DNA, 121 bp, Homo sapiens
cctgtttatgaggacacgcagaggggacttggcctcctactgctgctttcagagagattcgaggcagagtggatgtttttgcaagatacagactgcctggctgtggaaagacgcgttgcct

SEQ ID NO: 1099 - DNA, 17 bp, Homo sapiens
ctctgcctcgaatctct

SEQ ID NO: 1100 - DNA, 17 bp, Homo sapiens
agagattcgaggcagag

SEQ ID NO: 1101 - DNA, 121 bp, Homo sapiens
atttcattgagcgcaaatatatctgaaacttctagcaataaaactagtagtgcagatacccaaaaagtggccattattgaacttacagatgggtggtatgctgttaaggcccagttagatc

SEQ ID NO: 1102 - DNA, 121 bp, Homo sapiens
gatctaactgggccttaacagcataccacccatctgtaagttcaataatggccactttttgggtatctgcactactagttttattgctagaagtttcagatatatttgcgctcaatgaaat

SEQ ID NO: 1103 - DNA, 17 bp, Homo sapiens
cagatacccaaaaagtg

SEQ ID NO: 1104 - DNA, 17 bp, Homo sapiens
cactttttgggtatctg

SEQ ID NO: 1105 - DNA, 121 bp, Homo sapiens
cagaactggtgggctctcctgatgcctgtacacctcttgaagccccagaatctcttatgttaaaggtaaattaatttgcactcttggtaaaaatcagtcattgattcagttaaattctaga

SEQ ID NO: 1106 - DNA, 121 bp, Homo sapiens
tctagaatttaactgaatcaatgactgatttttaccaagagtgcaaattaatttacctttaacataagagattctggggcttcaagaggtgtacaggcatcaggagagcccaccagttctg

SEQ ID NO: 1107 - DNA, 17 bp, Homo sapiens
tcttatgttaaagattt

SEQ ID NO: 1108 - DNA, 17 bp, Homo sapiens
aaatctttaacataaga

SEQ ID NO: 1109 - DNA, 121 bp, Homo sapiens
ccttttgttttcttagaaaacacaacaaaaccatatttaccatcacgtgcactaacaagacagcaagttcgtgctttgcaagatggtgcagagctttatgaagcagtgaagaatgcagcag

SEQ ID NO: 1110 - DNA, 121 bp, Homo sapiens
ctgctgcattcttcactgcttcataaagctctgcaccatcttgcaaagcacgaacttgctgtcttgttagtgcacgtgatggtaaatatggttttgttgtgttttctaagaaaacaaaagg

SEQ ID NO: 1111 - DNA, 17 bp, Homo sapiens
taacaagacagcaagtt

SEQ ID NO: 1112 - DNA, 17 bp, Homo sapiens
aacttgctgtcttgtta

SEQ ID NO: 1113 - DNA, 121 bp, Homo sapiens
aatcacaggcaaatgttgaatgataagaaacaagctcagatccagttggaaattaggaaggccatggaatctgctgaacaaaaggaacaaggtttatcaagggatgtcacaaccgtgtgga

SEQ ID NO: 1114 - DNA, 121 bp, Homo sapiens
tccacacggttgtgacatcccttgataaaccttgttccttttgttcagcagattccatggccttcctaatttccaactggatctgagcttgtttcttatcattcaacatttgcctgtgatt

SEQ ID NO: 1115 - DNA, 17 bp, Homo sapiens
ttaggaaggccatggaa

SEQ ID NO: 1116 - DNA, 17 bp, Homo sapiens
ttccatggccttcctaa

SEQ ID NO: 1117 - DNA, 121 bp, Homo sapiens
acaatttactggcaataaagttttggatagaccttaatgaggacattattaagcctcatatgttaattgctgcaagcaacctccagtggcgaccagaatccaaatcaggccttcttacttt

SEQ ID NO: 1118 - DNA, 121 bp, Homo sapiens
aaagtaagaaggcctgatttggattctggtcgccactggaggttgcttgcagcaattaacatatgaggcttaataatgtcctcattaaggtctatccaaaactttattgccagtaaattgt

SEQ ID NO: 1119 - DNA, 17 bp, Homo sapiens
gcctcatatgttaattg

SEQ ID NO: 1120 - DNA, 17 bp, Homo sapiens
caattaacatatgaggc

SEQ ID NO: 1121 - DNA, 121 bp, Homo sapiens
gactgaaacgacgttgtactacatctctgatcaaagaacaggagagttcccaggccagtacggaagaatgtgagaaaaataagcaggacacaattacaactaaaaaatatatctaagcatt

SEQ ID NO: 1122 - DNA, 121 bp, Homo sapiens
aatgcttagatatattttttagttgtaattgtgtcctgcttatttttctcacattcttccgtactggcctgggaactctcctgttctttgatcagagatgtagtacaacgtcgtttcagtc

SEQ ID NO: 1123 - DNA, 17 bp, Homo sapiens
ggccagtacggaagaat

SEQ ID NO: 1124 - DNA, 17 bp, Homo sapiens
attcttccgtactggcc

SEQ ID NO: 1125 - DNA, 121 bp, Homo sapiens
aaagaacaggagagttcccaggccagtacggaagaatgtgagaaaaataagcaggacacaattacaactaaaaaatatatctaagcatttgcaaaggcgacaataaattattgacgcttaa

SEQ ID NO: 1126 - DNA, 121 bp, Homo sapiens
ttaagcgtcaataatttattgtcgcctttgcaaatgcttagatatattttttagttgtaattgtgtcctgcttatttttctcacattcttccgtactggcctgggaactctcctgttcttt

SEQ ID NO: 1127 - DNA, 17 bp, Homo sapiens
aggacacaattacaact

SEQ ID NO: 1128 - DNA, 17 bp, Homo sapiens
agttgtaattgtgtcct

SEQ ID NO: 1129 - DNA, 121 bp, Homo sapiens
aaggatacagacagcgcctggaattgtcagacatataccaaatcccttctgttgattctgctgacaatctatctgaaaaattggaaaggtatgttcatgtacattgtttagttgaagagag

SEQ ID NO: 1130 - DNA, 121 bp, Homo sapiens
ctctcttcaactaaacaatgtacatgaacatacctttccaatttttcagatagattgtcagcagaatcaacagaagggatttggtatatgtctgacaattccaggcgctgtctgtatcctt

SEQ ID NO: 1131 - DNA, 17 bp, Homo sapiens
tgattctgctgacaatc

SEQ ID NO: 1132 - DNA, 17 bp, Homo sapiens
gattgtcagcagaatca

SEQ ID NO: 1133 - DNA, 121 bp, Homo sapiens
agcgcctggaattgtcagacatataccaaatcccttctgttgattctgctgacaatctatctgaaaaattggaaaggtatgttcatgtacattgtttagttgaagagagaaattcatatta

SEQ ID NO: 1134 - DNA, 121 bp, Homo sapiens
taatatgaatttctctcttcaactaaacaatgtacatgaacatacctttccaatttttcagatagattgtcagcagaatcaacagaagggatttggtatatgtctgacaattccaggcgct

SEQ ID NO: 1135 - DNA, 17 bp, Homo sapiens
caatctatctgaaaaat

SEQ ID NO: 1136 - DNA, 17 bp, Homo sapiens
atttttcagatagattg

SEQ ID NO: 1137 - DNA, 121 bp, Homo sapiens
aggacaactaaaatatttgcacatgcaacttattggtcccactttttattcttttgcagagaatgggatagagagctggcttcaaagaaaaatcctaaactcattaatgcccttcggcgat

SEQ ID NO: 1138 - DNA, 121 bp, Homo sapiens
atcgccgaagggcattaatgagtttaggatttttctttgaagccagctctctatcccattctctgcaaaagaataaaaagtgggaccaataagttgcatgtgcaaatattttagttgtcct

SEQ ID NO: 1139 - DNA, 17 bp, Homo sapiens
tttgcagagaatgggat

SEQ ID NO: 1140 - DNA, 17 bp, Homo sapiens
atcccattctctgcaaa

SEQ ID NO: 1141 - DNA, 121 bp, Homo sapiens; identical to SEQ ID NO: 1137

SEQ ID NO: 1142 - DNA, 121 bp, Homo sapiens; identical to SEQ ID NO: 1138

SEQ ID NO: 1143 - DNA, 17 bp, Homo sapiens
tttgcagagaatgggat

SEQ ID NO: 1144 - DNA, 17 bp, Homo sapiens
atcccattctctgcaaa

SEQ ID NO: 1145 - DNA, 121 bp, Homo sapiens
aactaaaatatttgcacatgcaacttattggtcccactttttattcttttgcagagaatgggatagagagctggcttcaaagaaaaatcctaaactcattaatgcccttcggcgatgtttt

SEQ ID NO: 1146 - DNA, 121 bp, Homo sapiens
aaaacatcgccgaagggcattaatgagtttaggatttttctttgaagccagctctctatcccattctctgcaaaagaataaaaagtgggaccaataagttgcatgtgcaaatattttagtt

SEQ ID NO: 1147 - DNA, 17 bp, Homo sapiens
agagaatgggatagaga

SEQ ID NO: 1148 - DNA, 17 bp, Homo sapiens
tctctatcccattctct

SEQ ID NO: 1149 - DNA, 121 bp, Homo sapiens
actaaaatatttgcacatgcaacttattggtcccactttttattcttttgcagagaatgggatagagagctggcttcaaagaaaaatcctaaactcattaatgcccttcggcgatgttttt

SEQ ID NO: 1150 - DNA, 121 bp, Homo sapiens
aaaaacatcgccgaagggcattaatgagtttaggatttttctttgaagccagctctctatcccattctctgcaaaagaataaaaagtgggaccaataagttgcatgtgcaaatattttagt

SEQ ID NO: 1151 - DNA, 17 bp, Homo sapiens
gagaatgggatagagag

SEQ ID NO: 1152 - DNA, 17 bp, Homo sapiens
ctctctatcccattctc

SEQ ID NO: 1153 - DNA, 121 bp, Homo sapiens
atatttgcacatgcaacttattggtcccactttttattcttttgcagagaatgggatagagagctggcttcaaagaaaaatcctaaactcattaatgcccttcggcgatgttttttctgga

SEQ ID NO: 1154 - DNA, 121 bp, Homo sapiens
tccagaaaaaacatcgccgaagggcattaatgagtttaggatttttctttgaagccagctctctatcccattctctgcaaaagaataaaaagtgggaccaataagttgcatgtgcaaatat

SEQ ID NO: 1155 - DNA, 17 bp, Homo sapiens
gggatagagagctggct

SEQ ID NO: 1156 - DNA, 17 bp, Homo sapiens
agccagctctctatccc

SEQ ID NO: 1157 - DNA, 121 bp, Homo sapiens
ggtcccactttttattcttttgcagagaatgggatagagagctggcttcaaagaaaaatcctaaactcattaatgcccttcggcgatgttttttctggagatttatgttctatggaatctt

SEQ ID NO: 1158 - DNA, 121 bp, Homo sapiens
aagattccatagaacataaatctccagaaaaaacatcgccgaagggcattaatgagtttaggatttttctttgaagccagctctctatcccattctctgcaaaagaataaaaagtgggacc

SEQ ID NO: 1159 - DNA, 17 bp, Homo sapiens
gaaaaatcctaaactca

SEQ ID NO: 1160 - DNA, 17 bp, Homo sapiens
tgagtttaggatttttc

SEQ ID NO: 1161 - DNA, 121 bp, Homo sapiens
tgcagagaatgggatagagagctggcttcaaagaaaaatcctaaactcattaatgcccttcggcgatgttttttctggagatttatgttctatggaatctttttatatttaggggtaagga

SEQ ID NO: 1162 - DNA, 121 bp, Homo sapiens
tccttacccctaaatataaaaagattccatagaacataaatctccagaaaaaacatcgccgaagggcattaatgagtttaggatttttctttgaagccagctctctatcccattctctgca

SEQ ID NO: 1163 - DNA, 17 bp, Homo sapiens
atgcccttcggcgatgt

SEQ ID NO: 1164 - DNA, 17 bp, Homo sapiens
acatcgccgaagggcat

SEQ ID NO: 1165 - DNA, 121 bp, Homo sapiens
gagaatgggatagagagctggcttcaaagaaaaatcctaaactcattaatgcccttcggcgatgttttttctggagatttatgttctatggaatctttttatatttaggggtaaggatctc

SEQ ID NO: 1166 - DNA, 121 bp, Homo sapiens
gagatccttacccctaaatataaaaagattccatagaacataaatctccagaaaaaacatcgccgaagggcattaatgagtttaggatttttctttgaagccagctctctatcccattctc

SEQ ID NO: 1167 - DNA, 17 bp, Homo sapiens
ccttcggcgatgttttt

SEQ ID NO: 1168 - DNA, 17 bp, Homo sapiens
aaaaacatcgccgaagg

SEQ ID NO: 1169 - DNA, 121 bp, Homo sapiens; identical to SEQ ID NO: 1165

SEQ ID NO: 1170 - DNA, 121 bp, Homo sapiens; identical to SEQ ID NO: 1166

SEQ ID NO: 1171 - DNA, 17 bp, Homo sapiens
ccttcggcgatgttttt

SEQ ID NO: 1172 - DNA, 17 bp, Homo sapiens
aaaaacatcgccgaagg

SEQ ID NO: 1173 - DNA, 121 bp, Homo sapiens
agagaatgggatagagagctggcttcaaagaaaaatcctaaactcattaatgcccttcggcgatgttttttctggagatttatgttctatggaatctttttatatttaggggtaaggatct

SEQ ID NO: 1174 - DNA, 121 bp, Homo sapiens
agatccttacccctaaatataaaaagattccatagaacataaatctccagaaaaaacatcgccgaagggcattaatgagtttaggatttttctttgaagccagctctctatcccattctct

SEQ ID NO: 1175 - DNA, 17 bp, Homo sapiens
cccttcggcgatgtttt

SEQ ID NO: 1176 - DNA, 17 bp, Homo sapiens
aaaacatcgccgaaggg

SEQ ID NO: 1177 - DNA, 121 bp, Homo sapiens
aaaatcctaaactcattaatgcccttcggcgatgttttttctggagatttatgttctatggaatctttttatatttaggggtaaggatctcatttgtacattcattatgtatcacataact

SEQ ID NO: 1178 - DNA, 121 bp, Homo sapiens
agttatgtgatacataatgaatgtacaaatgagatccttacccctaaatataaaaagattccatagaacataaatctccagaaaaaacatcgccgaagggcattaatgagtttaggatttt

SEQ ID NO: 1179 - DNA, 17 bp, Homo sapiens
gttctatggaatctttt

SEQ ID NO: 1180 - DNA, 17 bp, Homo sapiens
aaaagattccatagaac

SEQ ID NO: 1181 - DNA, 121 bp, Homo sapiens; identical to SEQ ID NO: 1177

SEQ ID NO: 1182 - DNA, 121 bp, Homo sapiens; identical to SEQ ID NO: 1178

SEQ ID NO: 1183 - DNA, 17 bp, Homo sapiens
gttctatggaatctttt

SEQ ID NO: 1184 - DNA, 17 bp, Homo sapiens
aaaagattccatagaac

SEQ ID NO: 1185 - DNA, 121 bp, Homo sapiens
aactcattaatgcccttcggcgatgttttttctggagatttatgttctatggaatctttttatatttaggggtaaggatctcatttgtacattcattatgtatcacataactatatgcatt

SEQ ID NO: 1186 - DNA, 121 bp, Homo sapiens
aatgcatatagttatgtgatacataatgaatgtacaaatgagatccttacccctaaatataaaaagattccatagaacataaatctccagaaaaaacatcgccgaagggcattaatgagtt

SEQ ID NO: 1187 - DNA, 17 bp, Homo sapiens
aatctttttatatttag

SEQ ID NO: 1188 - DNA, 17 bp, Homo sapiens
ctaaatataaaaagatt

SEQ ID NO: 1189 - DNA, 121 bp, Homo sapiens
cctaaactcattaatgcccttcggcgatgttttttctggagatttatgttctatggaatctttttatatttaggggtaaggatctcatttgtacattcattatgtatcacataactatatg

SEQ ID NO: 1190 - DNA, 121 bp, Homo sapiens
catatagttatgtgatacataatgaatgtacaaatgagatccttacccctaaatataaaaagattccatagaacataaatctccagaaaaaacatcgccgaagggcattaatgagtttagg

SEQ ID NO: 1191 - DNA, 17 bp, Homo sapiens
atggaatctttttatat

SEQ ID NO: 1192 - DNA, 17 bp, Homo sapiens
atataaaaagattccat

SEQ ID NO: 1193 - DNA, 121 bp, Homo sapiens; identical to SEQ ID NO: 1185

SEQ ID NO: 1194 - DNA, 121 bp, Homo sapiens; identical to SEQ ID NO: 1186

SEQ ID NO: 1195 - DNA, 17 bp, Homo sapiens
aatctttttatatttag

SEQ ID NO: 1196 - DNA, 17 bp, Homo sapiens
ctaaatataaaaagatt

SEQ ID NO: 1197 - DNA, 121 bp, Homo sapiens; identical to SEQ ID NO: 1185

SEQ ID NO: 1198 - DNA, 121 bp, Homo sapiens; identical to SEQ ID NO: 1186

SEQ ID NO: 1199 - DNA, 17 bp, Homo sapiens
aatctttttatatttag

SEQ ID NO: 1200 - DNA, 17 bp, Homo sapiens
ctaaatataaaaagatt

SEQ ID NO: 1201 - DNA, 121 bp, Homo sapiens
aatgcccttcggcgatgttttttctggagatttatgttctatggaatctttttatatttaggggtaaggatctcatttgtacattcattatgtatcacataactatatgcatttttgtgat

SEQ ID NO: 1202 - DNA, 121 bp, Homo sapiens
atcacaaaaatgcatatagttatgtgatacataatgaatgtacaaatgagatccttacccctaaatataaaaagattccatagaacataaatctccagaaaaaacatcgccgaagggcatt

SEQ ID NO: 1203 - DNA, 17 bp, Homo sapiens
tatatttaggggtaagg

SEQ ID NO: 1204 - DNA, 17 bp, Homo sapiens
ccttacccctaaatata

SEQ ID NO: 1205 - DNA, 121 bp, Homo sapiens
aataaatgaaatttaatttctctgtttttccccttttgtaggaagtcaccaaagcagtacagcctctcttactgggaagaatcatagcttcctatgacccggataacaaggaggaacgctc

SEQ ID NO: 1206 - DNA, 121 bp, Homo sapiens
gagcgttcctccttgttatccgggtcataggaagctatgattcttcccagtaagagaggctgtactgctttggtgacttcctacaaaaggggaaaaacagagaaattaaatttcatttatt

SEQ ID NO: 1207 - DNA, 17 bp, Homo sapiens
agcagtacagcctctct

SEQ ID NO: 1208 - DNA, 17 bp, Homo sapiens
agagaggctgtactgct

SEQ ID NO: 1209 - DNA, 121 bp, Homo sapiens
aaataaatgaaatttaatttctctgtttttccccttttgtaggaagtcaccaaagcagtacagcctctcttactgggaagaatcatagcttcctatgacccggataacaaggaggaacgct

SEQ ID NO: 1210 - DNA, 121 bp, Homo sapiens
agcgttcctccttgttatccgggtcataggaagctatgattcttcccagtaagagaggctgtactgctttggtgacttcctacaaaaggggaaaaacagagaaattaaatttcatttattt

SEQ ID NO: 1211 - DNA, 17 bp, Homo sapiens
aagcagtacagcctctc

SEQ ID NO: 1212 - DNA, 17 bp, Homo sapiens
gagaggctgtactgctt

SEQ ID NO: 1213 - DNA, 121 bp, Homo sapiens
cccttttgtaggaagtcaccaaagcagtacagcctctcttactgggaagaatcatagcttcctatgacccggataacaaggaggaacgctctatcgcgatttatctaggcataggcttatg

SEQ ID NO: 1214 - DNA, 121 bp, Homo sapiens
cataagcctatgcctagataaatcgcgatagagcgttcctccttgttatccgggtcataggaagctatgattcttcccagtaagagaggctgtactgctttggtgacttcctacaaaaggg

SEQ ID NO: 1215 - DNA, 17 bp, Homo sapiens
catagcttcctatgacc

SEQ ID NO: 1216 - DNA, 17 bp, Homo sapiens
ggtcataggaagctatg

SEQ ID NO: 1217 - DNA, 121 bp, Homo sapiens
ttttgtaggaagtcaccaaagcagtacagcctctcttactgggaagaatcatagcttcctatgacccggataacaaggaggaacgctctatcgcgatttatctaggcataggcttatgcct

SEQ ID NO: 1218 - DNA, 121 bp, Homo sapiens
aggcataagcctatgcctagataaatcgcgatagagcgttcctccttgttatccgggtcataggaagctatgattcttcccagtaagagaggctgtactgctttggtgacttcctacaaaa

SEQ ID NO: 1219 - DNA, 17 bp, Homo sapiens
agcttcctatgacccgg

SEQ ID NO: 1220 - DNA, 17 bp, Homo sapiens
ccgggtcataggaagct

SEQ ID NO: 1221 - DNA, 121 bp, Homo sapiens
ttgtaggaagtcaccaaagcagtacagcctctcttactgggaagaatcatagcttcctatgacccggataacaaggaggaacgctctatcgcgatttatctaggcataggcttatgccttc

SEQ ID NO: 1222 - DNA, 121 bp, Homo sapiens
gaaggcataagcctatgcctagataaatcgcgatagagcgttcctccttgttatccgggtcataggaagctatgattcttcccagtaagagaggctgtactgctttggtgacttcctacaa

SEQ ID NO: 1223 - DNA, 17 bp, Homo sapiens
cttcctatgacccggat

SEQ ID NO: 1224 - DNA, 17 bp, Homo sapiens
atccgggtcataggaag

SEQ ID NO: 1225 - DNA, 121 bp, Homo sapiens
aggaagtcaccaaagcagtacagcctctcttactgggaagaatcatagcttcctatgacccggataacaaggaggaacgctctatcgcgatttatctaggcataggcttatgccttctctt

SEQ ID NO: 1226 - DNA, 121 bp, Homo sapiens
aagagaaggcataagcctatgcctagataaatcgcgatagagcgttcctccttgttatccgggtcataggaagctatgattcttcccagtaagagaggctgtactgctttggtgacttcct

SEQ ID NO: 1227 - DNA, 17 bp, Homo sapiens
ctatgacccggataaca

SEQ ID NO: 1228 - DNA, 17 bp, Homo sapiens
tgttatccgggtcatag

SEQ ID NO: 1229 - DNA, 121 bp, Homo sapiens
gtacagcctctcttactgggaagaatcatagcttcctatgacccggataacaaggaggaacgctctatcgcgatttatctaggcataggcttatgccttctctttattgtgaggacactgc

SEQ ID NO: 1230 - DNA, 121 bp, Homo sapiens
gcagtgtcctcacaataaagagaaggcataagcctatgcctagataaatcgcgatagagcgttcctccttgttatccgggtcataggaagctatgattcttcccagtaagagaggctgtac

SEQ ID NO: 1231 - DNA, 17 bp, Homo sapiens
aggaggaacgctctatc

SEQ ID NO: 1232 - DNA, 17 bp, Homo sapiens
gatagagcgttcctcct

SEQ ID NO: 1233 - DNA, 121 bp, Homo sapiens
tacagcctctcttactgggaagaatcatagcttcctatgacccggataacaaggaggaacgctctatcgcgatttatctaggcataggcttatgccttctctttattgtgaggacactgct

SEQ ID NO: 1234 - DNA, 121 bp, Homo sapiens
agcagtgtcctcacaataaagagaaggcataagcctatgcctagataaatcgcgatagagcgttcctccttgttatccgggtcataggaagctatgattcttcccagtaagagaggctgta

SEQ ID NO: 1235 - DNA, 17 bp, Homo sapiens
ggaggaacgctctatcg

SEQ ID NO: 1236 - DNA, 17 bp, Homo sapiens
cgatagagcgttcctcc

SEQ ID NO: 1237 - DNA, 121 bp, Homo sapiens; identical to SEQ ID NO: 1233

SEQ ID NO: 1238 - DNA, 121 bp, Homo sapiens; identical to SEQ ID NO: 1234

SEQ ID NO: 1239 - DNA, 17 bp, Homo sapiens
ggaggaacgctctatcg

SEQ ID NO: 1240 - DNA, 17 bp, Homo sapiens
cgatagagcgttcctcc

SEQ ID NO: 1241 - DNA, 121 bp, Homo sapiens; identical to SEQ ID NO: 1233

SEQ ID NO: 1242 - DNA, 121 bp, Homo sapiens; identical to SEQ ID NO: 1234

SEQ ID NO: 1243 - DNA, 17 bp, Homo sapiens
ggaggaacgctctatcg

SEQ ID NO: 1244 - DNA, 17 bp, Homo sapiens
cgatagagcgttcctcc

SEQ ID NO: 1245 - DNA, 121 bp, Homo sapiens
ctcttactgggaagaatcatagcttcctatgacccggataacaaggaggaacgctctatcgcgatttatctaggcataggcttatgccttctctttattgtgaggacactgctcctacacc

SEQ ID NO: 1246 - DNA, 121 bp, Homo sapiens
ggtgtaggagcagtgtcctcacaataaagagaaggcataagcctatgcctagataaatcgcgatagagcgttcctccttgttatccgggtcataggaagctatgattcttcccagtaagag

SEQ ID NO: 1247 - DNA, 17 bp, Homo sapiens
gctctatcgcgatttat

SEQ ID NO: 1248 - DNA, 17 bp, Homo sapiens
ataaatcgcgatagagc

SEQ ID NO: 1249 - DNA, 121 bp, Homo sapiens
gggaagaatcatagcttcctatgacccggataacaaggaggaacgctctatcgcgatttatctaggcataggcttatgccttctctttattgtgaggacactgctcctacacccagccatt

SEQ ID NO: 1250 - DNA, 121 bp, Homo sapiens
aatggctgggtgtaggagcagtgtcctcacaataaagagaaggcataagcctatgcctagataaatcgcgatagagcgttcctccttgttatccgggtcataggaagctatgattcttccc

SEQ ID NO: 1251 - DNA, 17 bp, Homo sapiens
gcgatttatctaggcat

SEQ ID NO: 1252 - DNA, 17 bp, Homo sapiens
atgcctagataaatcgc

SEQ ID NO: 1253 - DNA, 121 bp, Homo sapiens
tagcttcctatgacccggataacaaggaggaacgctctatcgcgatttatctaggcataggcttatgccttctctttattgtgaggacactgctcctacacccagccatttttggccttca

SEQ ID NO: 1254 - DNA, 121 bp, Homo sapiens
tgaaggccaaaaatggctgggtgtaggagcagtgtcctcacaataaagagaaggcataagcctatgcctagataaatcgcgatagagcgttcctccttgttatccgggtcataggaagcta

SEQ ID NO: 1255 - DNA, 17 bp, Homo sapiens
aggcataggcttatgcc

SEQ ID NO: 1256 - DNA, 17 bp, Homo sapiens
ggcataagcctatgcct

SEQ ID NO: 1257 - DNA, 121 bp, Homo sapiens
tcgcgatttatctaggcataggcttatgccttctctttattgtgaggacactgctcctacacccagccatttttggccttcatcacattggaatgcagatgagaatagctatgtttagttt

SEQ ID NO: 1258 - DNA, 121 bp, Homo sapiens
aaactaaacatagctattctcatctgcattccaatgtgatgaaggccaaaaatggctgggtgtaggagcagtgtcctcacaataaagagaaggcataagcctatgcctagataaatcgcga

SEQ ID NO: 1259 - DNA, 17 bp, Homo sapiens
gctcctacacccagcca

SEQ ID NO: 1260 - DNA, 17 bp, Homo sapiens
tggctgggtgtaggagc

SEQ ID NO: 1261 - DNA, 121 bp, Homo sapiens
tttatctaggcataggcttatgccttctctttattgtgaggacactgctcctacacccagccatttttggccttcatcacattggaatgcagatgagaatagctatgtttagtttgattta

SEQ ID NO: 1262 - DNA, 121 bp, Homo sapiens
taaatcaaactaaacatagctattctcatctgcattccaatgtgatgaaggccaaaaatggctgggtgtaggagcagtgtcctcacaataaagagaaggcataagcctatgcctagataaa

SEQ ID NO: 1263 - DNA, 17 bp, Homo sapiens
acacccagccatttttg

SEQ ID NO: 1264 - DNA, 17 bp, Homo sapiens
caaaaatggctgggtgt

SEQ ID NO: 1265 - DNA, 121 bp, Homo sapiens
gccttctctttattgtgaggacactgctcctacacccagccatttttggccttcatcacattggaatgcagatgagaatagctatgtttagtttgatttataagaaggtaatacttccttg

SEQ ID NO: 1266 - DNA, 121 bp, Homo sapiens
caaggaagtattaccttcttataaatcaaactaaacatagctattctcatctgcattccaatgtgatgaaggccaaaaatggctgggtgtaggagcagtgtcctcacaataaagagaaggc

SEQ ID NO: 1267 - DNA, 17 bp, Homo sapiens
tcatcacattggaatgc

SEQ ID NO: 1268 - DNA, 17 bp, Homo sapiens
gcattccaatgtgatga

SEQ ID NO: 1269 - DNA, 121 bp, Homo sapiens
cttctctttattgtgaggacactgctcctacacccagccatttttggccttcatcacattggaatgcagatgagaatagctatgtttagtttgatttataagaaggtaatacttccttgca

SEQ ID NO: 1270 - DNA, 121 bp, Homo sapiens
tgcaaggaagtattaccttcttataaatcaaactaaacatagctattctcatctgcattccaatgtgatgaaggccaaaaatggctgggtgtaggagcagtgtcctcacaataaagagaag

SEQ ID NO: 1271 - DNA, 17 bp, Homo sapiens
atcacattggaatgcag

SEQ ID NO: 1272 - DNA, 17 bp, Homo sapiens
ctgcattccaatgtgat

SEQ ID NO: 1273 - DNA, 121 bp, Homo sapiens
tttattgtgaggacactgctcctacacccagccatttttggccttcatcacattggaatgcagatgagaatagctatgtttagtttgatttataagaaggtaatacttccttgcacaggcc

SEQ ID NO: 1274 - DNA, 121 bp, Homo sapiens
ggcctgtgcaaggaagtattaccttcttataaatcaaactaaacatagctattctcatctgcattccaatgtgatgaaggccaaaaatggctgggtgtaggagcagtgtcctcacaataaa

SEQ ID NO: 1275 - DNA, 17 bp, Homo sapiens
ttggaatgcagatgaga

SEQ ID NO: 1276 - DNA, 17 bp, Homo sapiens
tctcatctgcattccaa

SEQ ID NO: 1277 - DNA, 121 bp, Homo sapiens
aatatatttgtattttgtttgttgaaattatctaactttccatttttcttttagactttaaagctgtcaagccgtgttctagataaaataagtattggacaacttgttagtctcctttcca

SEQ ID NO: 1278 - DNA, 121 bp, Homo sapiens
tggaaaggagactaacaagttgtccaatacttattttatctagaacacggcttgacagctttaaagtctaaaagaaaaatggaaagttagataatttcaacaaacaaaatacaaatatatt

SEQ ID NO: 1279 - DNA, 17 bp, Homo sapiens
agactttaaagctgtca

SEQ ID NO: 1280 - DNA, 17 bp, Homo sapiens
tgacagctttaaagtct

SEQ ID NO: 1281 - DNA, 121 bp, Homo sapiens
ttatctaactttccatttttcttttagactttaaagctgtcaagccgtgttctagataaaataagtattggacaacttgttagtctcctttccaacaacctgaacaaatttgatgaagtat

SEQ ID NO: 1282 - DNA, 121 bp, Homo sapiens
atacttcatcaaatttgttcaggttgttggaaaggagactaacaagttgtccaatacttattttatctagaacacggcttgacagctttaaagtctaaaagaaaaatggaaagttagataa

SEQ ID NO: 1283 - DNA, 17 bp, Homo sapiens
tagataaaataagtatt

SEQ ID NO: 1284 - DNA, 17 bp, Homo sapiens
aatacttattttatcta

SEQ ID NO: 1285 - DNA, 121 bp, Homo sapiens
tttccatttttcttttagactttaaagctgtcaagccgtgttctagataaaataagtattggacaacttgttagtctcctttccaacaacctgaacaaatttgatgaagtatgtacctatt

SEQ ID NO: 1286 - DNA, 121 bp, Homo sapiens
aataggtacatacttcatcaaatttgttcaggttgttggaaaggagactaacaagttgtccaatacttattttatctagaacacggcttgacagctttaaagtctaaaagaaaaatggaaa

SEQ ID NO: 1287 - DNA, 17 bp, Homo sapiens
taagtattggacaactt

SEQ ID NO: 1288 - DNA, 17 bp, Homo sapiens
aagttgtccaatactta

SEQ ID NO: 1289 - DNA, 121 bp, Homo sapiens
aagatacaatgacacctgtttttgctgtgcttttattttccagggacttgcattggcacatttcgtgtggatcgctcctttgcaagtggcactcctcatggggctaatctgggagttgtta

SEQ ID NO: 1290 - DNA, 121 bp, Homo sapiens
taacaactcccagattagccccatgaggagtgccacttgcaaaggagcgatccacacgaaatgtgccaatgcaagtccctggaaaataaaagcacagcaaaaacaggtgtcattgtatctt

SEQ ID NO: 1291 - DNA, 17 bp, Homo sapiens
ttggcacatttcgtgtg

SEQ ID NO: 1292 - DNA, 17 bp, Homo sapiens
cacacgaaatgtgccaa

SEQ ID NO: 1293 - DNA, 121 bp, Homo sapiens
ggaagatacaatgacacctgtttttgctgtgcttttattttccagggacttgcattggcacatttcgtgtggatcgctcctttgcaagtggcactcctcatggggctaatctgggagttgt

SEQ ID NO: 1294 - DNA, 121 bp, Homo sapiens
acaactcccagattagccccatgaggagtgccacttgcaaaggagcgatccacacgaaatgtgccaatgcaagtccctggaaaataaaagcacagcaaaaacaggtgtcattgtatcttcc

SEQ ID NO: 1295 - DNA, 17 bp, Homo sapiens
cattggcacatttcgtg

SEQ ID NO: 1296 - DNA, 17 bp, Homo sapiens
cacgaaatgtgccaatg

SEQ ID NO: 1297 - DNA, 121 bp, Homo sapiens
tgtttttgctgtgcttttattttccagggacttgcattggcacatttcgtgtggatcgctcctttgcaagtggcactcctcatggggctaatctgggagttgttacaggcgtctgccttct

SEQ ID NO: 1298 - DNA, 121 bp, Homo sapiens
agaaggcagacgcctgtaacaactcccagattagccccatgaggagtgccacttgcaaaggagcgatccacacgaaatgtgccaatgcaagtccctggaaaataaaagcacagcaaaaaca

SEQ ID NO: 1299 - DNA, 17 bp, Homo sapiens
ggatcgctcctttgcaa

SEQ ID NO: 1300 - DNA, 17 bp, Homo sapiens
ttgcaaaggagcgatcc

SEQ ID NO: 1301 - DNA, 121 bp, Homo sapiens
tttgctgtgcttttattttccagggacttgcattggcacatttcgtgtggatcgctcctttgcaagtggcactcctcatggggctaatctgggagttgttacaggcgtctgccttctgtgg

SEQ ID NO: 1302 - DNA, 121 bp, Homo sapiens
ccacagaaggcagacgcctgtaacaactcccagattagccccatgaggagtgccacttgcaaaggagcgatccacacgaaatgtgccaatgcaagtccctggaaaataaaagcacagcaaa

SEQ ID NO: 1303 - DNA, 17 bp, Homo sapiens
cgctcctttgcaagtgg

SEQ ID NO: 1304 - DNA, 17 bp, Homo sapiens
ccacttgcaaaggagcg

SEQ ID NO: 1305 - DNA, 121 bp, Homo sapiens
ttcgtgtggatcgctcctttgcaagtggcactcctcatggggctaatctgggagttgttacaggcgtctgccttctgtggacttggtttcctgatagtccttgccctttttcaggctgggc

SEQ ID NO: 1306 - DNA, 121 bp, Homo sapiens
gcccagcctgaaaaagggcaaggactatcaggaaaccaagtccacagaaggcagacgcctgtaacaactcccagattagccccatgaggagtgccacttgcaaaggagcgatccacacgaa

SEQ ID NO: 1307 - DNA, 17 bp, Homo sapiens
agttgttacaggcgtct

SEQ ID NO: 1308 - DNA, 17 bp, Homo sapiens
agacgcctgtaacaact

SEQ ID NO: 1309 - DNA, 121 bp, Homo sapiens
cctttgcaagtggcactcctcatggggctaatctgggagttgttacaggcgtctgccttctgtggacttggtttcctgatagtccttgccctttttcaggctgggctagggagaatgatga

SEQ ID NO: 1310 - DNA, 121 bp, Homo sapiens
tcatcattctccctagcccagcctgaaaaagggcaaggactatcaggaaaccaagtccacagaaggcagacgcctgtaacaactcccagattagccccatgaggagtgccacttgcaaagg

SEQ ID NO: 1311 - DNA, 17 bp, Homo sapiens
ctgccttctgtggactt

SEQ ID NO: 1312 - DNA, 17 bp, Homo sapiens
aagtccacagaaggcag

SEQ ID NO: 1313 - DNA, 121 bp, Homo sapiens
tggggctaatctgggagttgttacaggcgtctgccttctgtggacttggtttcctgatagtccttgccctttttcaggctgggctagggagaatgatgatgaagtacaggtagcaacctat

SEQ ID NO: 1314 - DNA, 121 bp, Homo sapiens
ataggttgctacctgtacttcatcatcattctccctagcccagcctgaaaaagggcaaggactatcaggaaaccaagtccacagaaggcagacgcctgtaacaactcccagattagcccca

SEQ ID NO: 1315 - DNA, 17 bp, Homo sapiens
cctgatagtccttgccc

SEQ ID NO: 1316 - DNA, 17 bp, Homo sapiens
gggcaaggactatcagg

SEQ ID NO: 1317 - DNA, 121 bp, Homo sapiens
gttacaggcgtctgccttctgtggacttggtttcctgatagtccttgccctttttcaggctgggctagggagaatgatgatgaagtacaggtagcaacctattttcataacttgaaagttt

SEQ ID NO: 1318 - DNA, 121 bp, Homo sapiens
aaactttcaagttatgaaaataggttgctacctgtacttcatcatcattctccctagcccagcctgaaaaagggcaaggactatcaggaaaccaagtccacagaaggcagacgcctgtaac

SEQ ID NO: 1319 - DNA, 17 bp, Homo sapiens
tttcaggctgggctagg

SEQ ID NO: 1320 - DNA, 17 bp, Homo sapiens
cctagcccagcctgaaa

SEQ ID NO: 1321 - DNA, 121 bp, Homo sapiens
gggcggcggggagcagcatggagccggcggcggggagcagcatggagccttcggctgactggctggccacggccgcggcccggggtcgggtagaggaggtgcgggcgctgctggaggcggg

SEQ ID NO: 1322 - DNA, 121 bp, Homo sapiens
cccgcctccagcagcgcccgcacctcctctacccgaccccgggccgcggccgtggccagccagtcagccgaaggctccatgctgctccccgccgccggctccatgctgctccccgccgccc

SEQ ID NO: 1323 - DNA, 17 bp, Homo sapiens
ggctgactggctggcca

SEQ ID NO: 1324 - DNA, 17 bp, Homo sapiens
tggccagccagtcagcc

SEQ ID NO: 1325 - DNA, 121 bp, Homo sapiens
cggcggggagcagcatggagccggcggcggggagcagcatggagccttcggctgactggctggccacggccgcggcccggggtcgggtagaggaggtgcgggcgctgctggaggcgggggc

SEQ ID NO: 1326 - DNA, 121 bp, Homo sapiens
gcccccgcctccagcagcgcccgcacctcctctacccgaccccgggccgcggccgtggccagccagtcagccgaaggctccatgctgctccccgccgccggctccatgctgctccccgccg

SEQ ID NO: 1327 - DNA, 17 bp, Homo sapiens
tgactggctggccacgg

SEQ ID NO: 1328 - DNA, 17 bp, Homo sapiens
ccgtggccagccagtca

SEQ ID NO: 1329 - DNA, 121 bp, Homo sapiens
cggcggcggggagcagcatggagccttcggctgactggctggccacggccgcggcccggggtcgggtagaggaggtgcgggcgctgctggaggcgggggcgctgcccaacgcaccgaatag

SEQ ID NO: 1330 - DNA, 121 bp, Homo sapiens
ctattcggtgcgttgggcagcgcccccgcctccagcagcgcccgcacctcctctacccgaccccgggccgcggccgtggccagccagtcagccgaaggctccatgctgctccccgccgccg

SEQ ID NO: 1331 - DNA, 17 bp, Homo sapiens
ggcccggggtcgggtag

SEQ ID NO: 1332 - DNA, 17 bp, Homo sapiens
ctacccgaccccgggcc

SEQ ID NO: 1333 - DNA, 121 bp, Homo sapiens
cggcggggagcagcatggagccttcggctgactggctggccacggccgcggcccggggtcgggtagaggaggtgcgggcgctgctggaggcgggggcgctgcccaacgcaccgaatagtta

SEQ ID NO: 1334 - DNA, 121 bp, Homo sapiens
taactattcggtgcgttgggcagcgcccccgcctccagcagcgcccgcacctcctctacccgaccccgggccgcggccgtggccagccagtcagccgaaggctccatgctgctccccgccg

SEQ ID NO: 1335 - DNA, 17 bp, Homo sapiens
ccggggtcgggtagagg

SEQ ID NO: 1336 - DNA, 17 bp, Homo sapiens
cctctacccgaccccgg

SEQ ID NO: 1337 - DNA, 121 bp, Homo sapiens
cggctgactggctggccacggccgcggcccggggtcgggtagaggaggtgcgggcgctgctggaggcgggggcgctgcccaacgcaccgaatagttacggtcggaggccgatccaggtggg

SEQ ID NO: 1338 - DNA, 121 bp, Homo sapiens
cccacctggatcggcctccgaccgtaactattcggtgcgttgggcagcgcccccgcctccagcagcgcccgcacctcctctacccgaccccgggccgcggccgtggccagccagtcagccg

SEQ ID NO: 1339 - DNA, 17 bp, Homo sapiens
ggcgctgctggaggcgg

SEQ ID NO: 1340 - DNA, 17 bp, Homo sapiens
ccgcctccagcagcgcc

SEQ ID NO: 1341 - DNA, 121 bp, Homo sapiens
ggctggccacggccgcggcccggggtcgggtagaggaggtgcgggcgctgctggaggcgggggcgctgcccaacgcaccgaatagttacggtcggaggccgatccaggtgggtagagggtc

SEQ ID NO: 1342 - DNA, 121 bp, Homo sapiens
gaccctctacccacctggatcggcctccgaccgtaactattcggtgcgttgggcagcgcccccgcctccagcagcgcccgcacctcctctacccgaccccgggccgcggccgtggccagcc

SEQ ID NO: 1343 - DNA, 17 bp, Homo sapiens
ggaggcgggggcgctgc

SEQ ID NO: 1344 - DNA, 17 bp, Homo sapiens
gcagcgcccccgcctcc

SEQ ID NO: 1345 - DNA, 121 bp, Homo sapiens
ggtagaggaggtgcgggcgctgctggaggcgggggcgctgcccaacgcaccgaatagttacggtcggaggccgatccaggtgggtagagggtctgcagcgggagcaggggatggcgggcga

SEQ ID NO: 1346 - DNA, 121 bp, Homo sapiens
tcgcccgccatcccctgctcccgctgcagaccctctacccacctggatcggcctccgaccgtaactattcggtgcgttgggcagcgcccccgcctccagcagcgcccgcacctcctctacc

SEQ ID NO: 1347 - DNA, 17 bp, Homo sapiens
aatagttacggtcggag

SEQ ID NO: 1348 - DNA, 17 bp, Homo sapiens
ctccgaccgtaactatt

SEQ ID NO: 1349 - DNA, 121 bp, Homo sapiens
tctcccatacctgcccccaccctggctctgaccactctgctctctctggcaggtcatgatgatgggcagcgcccgcgtggcggagctgctgctgctccacggcgcggagcccaactgcgca

SEQ ID NO: 1350 - DNA, 121 bp, Homo sapiens
tgcgcagttgggctccgcgccgtggagcagcagcagctccgccacgcgggcgctgcccatcatcatgacctgccagagagagcagagtggtcagagccagggtgggggcaggtatgggaga

SEQ ID NO: 1351 - DNA, 17 bp, Homo sapiens
gtcatgatgatgggcag

SEQ ID NO: 1352 - DNA, 17 bp, Homo sapiens
ctgcccatcatcatgac

SEQ ID NO: 1353 - DNA, 121 bp, Homo sapiens
cccatacctgcccccaccctggctctgaccactctgctctctctggcaggtcatgatgatgggcagcgcccgcgtggcggagctgctgctgctccacggcgcggagcccaactgcgcagac

SEQ ID NO: 1354 - DNA, 121 bp, Homo sapiens
gtctgcgcagttgggctccgcgccgtggagcagcagcagctccgccacgcgggcgctgcccatcatcatgacctgccagagagagcagagtggtcagagccagggtgggggcaggtatggg

SEQ ID NO: 1355 - DNA, 17 bp, Homo sapiens
atgatgatgggcagcgc

SEQ ID NO: 1356 - DNA, 17 bp, Homo sapiens
gcgctgcccatcatcat

SEQ ID NO: 1357 - DNA, 121 bp, Homo sapiens
gccggcccccaccctggctctgaccattctgttctctctggcaggtcatgatgatgggcagcgcccgagtggcggagctgctgctgctccacggcgcggagcccaactgcgccgaccccgc

SEQ ID NO: 1358 - DNA, 121 bp, Homo sapiens
gcggggtcggcgcagttgggctccgcgccgtggagcagcagcagctccgccactcgggcgctgcccatcatcatgacctgccagagagaacagaatggtcagagccagggtgggggccggc

SEQ ID NO: 1359 - DNA, 17 bp, Homo sapiens
gatgggcagcgcccgag

SEQ ID NO: 1360 - DNA, 17 bp, Homo sapiens
ctcgggcgctgcccatc

SEQ ID NO: 1361 - DNA, 121 bp, Homo sapiens
ggcccccaccctggctctgaccattctgttctctctggcaggtcatgatgatgggcagcgcccgagtggcggagctgctgctgctccacggcgcggagcccaactgcgccgaccccgccac

SEQ ID NO: 1362 - DNA, 121 bp, Homo sapiens
gtggcggggtcggcgcagttgggctccgcgccgtggagcagcagcagctccgccactcgggcgctgcccatcatcatgacctgccagagagaacagaatggtcagagccagggtgggggcc

SEQ ID NO: 1363 - DNA, 17 bp, Homo sapiens
gggcagcgcccgagtgg

SEQ ID NO: 1364 - DNA, 17 bp, Homo sapiens
ccactcgggcgctgccc

SEQ ID NO: 1365 - DNA, 121 bp, Homo sapiens
cccccaccctggctctgaccattctgttctctctggcaggtcatgatgatgggcagcgcccgagtggcggagctgctgctgctccacggcgcggagcccaactgcgccgaccccgccactc

SEQ ID NO: 1366 - DNA, 121 bp, Homo sapiens
gagtggcggggtcggcgcagttgggctccgcgccgtggagcagcagcagctccgccactcgggcgctgcccatcatcatgacctgccagagagaacagaatggtcagagccagggtggggg

SEQ ID NO: 1367 - DNA, 17 bp, Homo sapiens
gcagcgcccgagtggcg

SEQ ID NO: 1368 - DNA, 17 bp, Homo sapiens
cgccactcgggcgctgc

SEQ ID NO: 1369 - DNA, 121 bp, Homo sapiens
caccctggctctgaccattctgttctctctggcaggtcatgatgatgggcagcgcccgagtggcggagctgctgctgctccacggcgcggagcccaactgcgccgaccccgccactctcac

SEQ ID NO: 1370 - DNA, 121 bp, Homo sapiens
gtgagagtggcggggtcggcgcagttgggctccgcgccgtggagcagcagcagctccgccactcgggcgctgcccatcatcatgacctgccagagagaacagaatggtcagagccagggtg

SEQ ID NO: 1371 - DNA, 17 bp, Homo sapiens
cgcccgagtggcggagc

SEQ ID NO: 1372 - DNA, 17 bp, Homo sapiens
gctccgccactcgggcg

SEQ ID NO: 1373 - DNA, 121 bp, Homo sapiens
tctgaccactctgctctctctggcaggtcatgatgatgggcagcgcccgcgtggcggagctgctgctgctccacggcgcggagcccaactgcgcagaccctgccactctcacccgaccggt

SEQ ID NO: 1374 - DNA, 121 bp, Homo sapiens
accggtcgggtgagagtggcagggtctgcgcagttgggctccgcgccgtggagcagcagcagctccgccacgcgggcgctgcccatcatcatgacctgccagagagagcagagtggtcaga

SEQ ID NO: 1375 - DNA, 17 bp, Homo sapiens
ggcggagctgctgctgc

SEQ ID NO: 1376 - DNA, 17 bp, Homo sapiens
gcagcagcagctccgcc

SEQ ID NO: 1377 - DNA, 121 bp, Homo sapiens
tctggcaggtcatgatgatgggcagcgcccgcgtggcggagctgctgctgctccacggcgcggagcccaactgcgcagaccctgccactctcacccgaccggtgcatgatgctgcccggga

SEQ ID NO: 1378 - DNA, 121 bp, Homo sapiens
tcccgggcagcatcatgcaccggtcgggtgagagtggcagggtctgcgcagttgggctccgcgccgtggagcagcagcagctccgccacgcgggcgctgcccatcatcatgacctgccaga

SEQ ID NO: 1379 - DNA, 17 bp, Homo sapiens
ccacggcgcggagccca

SEQ ID NO: 1380 - DNA, 17 bp, Homo sapiens
tgggctccgcgccgtgg

SEQ ID NO: 1381 - DNA, 121 bp, Homo sapiens
catgatgatgggcagcgcccgagtggcggagctgctgctgctccacggcgcggagcccaactgcgccgaccccgccactctcacccgacccgtgcacgacgctgcccgggagggcttcctg

SEQ ID NO: 1382 - DNA, 121 bp, Homo sapiens
caggaagccctcccgggcagcgtcgtgcacgggtcgggtgagagtggcggggtcggcgcagttgggctccgcgccgtggagcagcagcagctccgccactcgggcgctgcccatcatcatg

SEQ ID NO: 1383 - DNA, 17 bp, Homo sapiens
gagcccaactgcgccga

SEQ ID NO: 1384 - DNA, 17 bp, Homo sapiens
tcggcgcagttgggctc

SEQ ID NO: 1385 - DNA, 121 bp, Homo sapiens
tcatgatgatgggcagcgcccgagtggcggagctgctgctgctccacggcgcggagcccaactgcgccgaccccgccactctcacccgacccgtgcacgacgctgcccgggagggcttcct

SEQ ID NO: 1386 - DNA, 121 bp, Homo sapiens
aggaagccctcccgggcagcgtcgtgcacgggtcgggtgagagtggcggggtcggcgcagttgggctccgcgccgtggagcagcagcagctccgccactcgggcgctgcccatcatcatga

SEQ ID NO: 1387 - DNA, 17 bp, Homo sapiens
ggagcccaactgcgccg

SEQ ID NO: 1388 - DNA, 17 bp, Homo sapiens
cggcgcagttgggctcc

SEQ ID NO: 1389 - DNA, 121 bp, Homo sapiens
agctgctgctgctccacggcgcggagcccaactgcgccgaccccgccactctcacccgacccgtgcacgacgctgcccgggagggcttcctggacacgctggtggtgctgcaccgggccgg

SEQ ID NO: 1390 - DNA, 121 bp, Homo sapiens
ccggcccggtgcagcaccaccagcgtgtccaggaagccctcccgggcagcgtcgtgcacgggtcgggtgagagtggcggggtcggcgcagttgggctccgcgccgtggagcagcagcagct

SEQ ID NO: 1391 - DNA, 17 bp, Homo sapiens
cacccgacccgtgcacg

SEQ ID NO: 1392 - DNA, 17 bp, Homo sapiens
cgtgcacgggtcgggtg

SEQ ID NO: 1393 - DNA, 121 bp, Homo sapiens
ctgctccacggcgcggagcccaactgcgccgaccccgccactctcacccgacccgtgcacgacgctgcccgggagggcttcctggacacgctggtggtgctgcaccgggccggggcgcggc

SEQ ID NO: 1394 - DNA, 121 bp, Homo sapiens
gccgcgccccggcccggtgcagcaccaccagcgtgtccaggaagccctcccgggcagcgtcgtgcacgggtcgggtgagagtggcggggtcggcgcagttgggctccgcgccgtggagcag

SEQ ID NO: 1395 - DNA, 17 bp, Homo sapiens
ccgtgcacgacgctgcc

SEQ ID NO: 1396 - DNA, 17 bp, Homo sapiens
ggcagcgtcgtgcacgg

SEQ ID NO: 1397 - DNA, 121 bp, Homo sapiens
ctccacggcgcggagcccaactgcgccgaccccgccactctcacccgacccgtgcacgacgctgcccgggagggcttcctggacacgctggtggtgctgcaccgggccggggcgcggctgg

SEQ ID NO: 1398 - DNA, 121 bp, Homo sapiens
ccagccgcgccccggcccggtgcagcaccaccagcgtgtccaggaagccctcccgggcagcgtcgtgcacgggtcgggtgagagtggcggggtcggcgcagttgggctccgcgccgtggag

SEQ ID NO: 1399 - DNA, 17 bp, Homo sapiens
tgcacgacgctgcccgg

SEQ ID NO: 1400 - DNA, 17 bp, Homo sapiens
ccgggcagcgtcgtgca

SEQ ID NO: 1401 - DNA, 121 bp, Homo sapiens
gcgcggagcccaactgcgccgaccccgccactctcacccgacccgtgcacgacgctgcccgggagggcttcctggacacgctggtggtgctgcaccgggccggggcgcggctggacgtgcg

SEQ ID NO: 1402 - DNA, 121 bp, Homo sapiens
cgcacgtccagccgcgccccggcccggtgcagcaccaccagcgtgtccaggaagccctcccgggcagcgtcgtgcacgggtcgggtgagagtggcggggtcggcgcagttgggctccgcgc

SEQ ID NO: 1403 - DNA, 17 bp, Homo sapiens
cgctgcccgggagggct

SEQ ID NO: 1404 - DNA, 17 bp, Homo sapiens
agccctcccgggcagcg

SEQ ID NO: 1405 - DNA, 121 bp, Homo sapiens
ggcgcggagcccaactgcgccgaccccgccactctcacccgacccgtgcacgacgctgcccgggagggcttcctggacacgctggtggtgctgcaccgggccggggcgcggctggacgtgc

SEQ ID NO: 1406 - DNA, 121 bp, Homo sapiens
gcacgtccagccgcgccccggcccggtgcagcaccaccagcgtgtccaggaagccctcccgggcagcgtcgtgcacgggtcgggtgagagtggcggggtcggcgcagttgggctccgcgcc

SEQ ID NO: 1407 - DNA, 17 bp, Homo sapiens
acgctgcccgggagggc

SEQ ID NO: 1408 - DNA, 17 bp, Homo sapiens
gccctcccgggcagcgt

SEQ ID NO: 1409 - DNA, 121 bp, Homo sapiens
ctctcacccgaccggtgcatgatgctgcccgggagggcttcctggacacgctggtggtgctgcaccgggccggggcgcggctggacgtgcgcgatgcctggggtcgtctgcccgtggactt

SEQ ID NO: 1410 - DNA, 121 bp, Homo sapiens
aagtccacgggcagacgaccccaggcatcgcgcacgtccagccgcgccccggcccggtgcagcaccaccagcgtgtccaggaagccctcccgggcagcatcatgcaccggtcgggtgagag

SEQ ID NO: 1411 - DNA, 17 bp, Homo sapiens
ggtggtgctgcaccggg

SEQ ID NO: 1412 - DNA, 17 bp, Homo sapiens
cccggtgcagcaccacc

SEQ ID NO: 1413 - DNA, 121 bp, Homo sapiens
cccgaccggtgcatgatgctgcccgggagggcttcctggacacgctggtggtgctgcaccgggccggggcgcggctggacgtgcgcgatgcctggggtcgtctgcccgtggacttggccga

SEQ ID NO: 1414 - DNA, 121 bp, Homo sapiens
tcggccaagtccacgggcagacgaccccaggcatcgcgcacgtccagccgcgccccggcccggtgcagcaccaccagcgtgtccaggaagccctcccgggcagcatcatgcaccggtcggg

SEQ ID NO: 1415 - DNA, 17 bp, Homo sapiens
gctgcaccgggccgggg

SEQ ID NO: 1416 - DNA, 17 bp, Homo sapiens
ccccggcccggtgcagc

SEQ ID NO: 1417 - DNA, 121 bp, Homo sapiens
ccggtgcatgatgctgcccgggagggcttcctggacacgctggtggtgctgcaccgggccggggcgcggctggacgtgcgcgatgcctggggtcgtctgcccgtggacttggccgaggagc

SEQ ID NO: 1418 - DNA, 121 bp, Homo sapiens
gctcctcggccaagtccacgggcagacgaccccaggcatcgcgcacgtccagccgcgccccggcccggtgcagcaccaccagcgtgtccaggaagccctcccgggcagcatcatgcaccgg

SEQ ID NO: 1419 - DNA, 17 bp, Homo sapiens
accgggccggggcgcgg

SEQ ID NO: 1420 - DNA, 17 bp, Homo sapiens
ccgcgccccggcccggt

SEQ ID NO: 1421 - DNA, 121 bp, Homo sapiens
cgggagggcttcctggacacgctggtggtgctgcaccgggccggggcgcggctggacgtgcgcgatgcctggggtcgtctgcccgtggacttggccgaggagcggggccaccgcgacgttg

SEQ ID NO: 1422 - DNA, 121 bp, Homo sapiens
caacgtcgcggtggccccgctcctcggccaagtccacgggcagacgaccccaggcatcgcgcacgtccagccgcgccccggcccggtgcagcaccaccagcgtgtccaggaagccctcccg

SEQ ID NO: 1423 - DNA, 17 bp, Homo sapiens
tggacgtgcgcgatgcc

SEQ ID NO: 1424 - DNA, 17 bp, Homo sapiens
ggcatcgcgcacgtcca

SEQ ID NO: 1425 - DNA, 121 bp, Homo sapiens
caccgggccggggcgcggctggacgtgcgcgatgcctggggccgtctgcccgtggacctggctgaggagctgggccatcgcgatgtcgcacggtacctgcgcgcggctgcggggggcacca

SEQ ID NO: 1426 - DNA, 121 bp, Homo sapiens
tggtgccccccgcagccgcgcgcaggtaccgtgcgacatcgcgatggcccagctcctcagccaggtccacgggcagacggccccaggcatcgcgcacgtccagccgcgccccggcccggtg

SEQ ID NO: 1427 - DNA, 17 bp, Homo sapiens
tggacctggctgaggag

SEQ ID NO: 1428 - DNA, 17 bp, Homo sapiens
ctcctcagccaggtcca

SEQ ID NO: 1429 - DNA, 121 bp, Homo sapiens
tgcgcgatgcctggggccgtctgcccgtggacctggctgaggagctgggccatcgcgatgtcgcacggtacctgcgcgcggctgcggggggcaccagaggcagtaaccatgcccgcataga

SEQ ID NO: 1430 - DNA, 121 bp, Homo sapiens
tctatgcgggcatggttactgcctctggtgccccccgcagccgcgcgcaggtaccgtgcgacatcgcgatggcccagctcctcagccaggtccacgggcagacggccccaggcatcgcgca

SEQ ID NO: 1431 - DNA, 17 bp, Homo sapiens
tcgcgatgtcgcacggt

SEQ ID NO: 1432 - DNA, 17 bp, Homo sapiens
accgtgcgacatcgcga

SEQ ID NO: 1433 - DNA, 121 bp, Homo sapiens
ggatctgtatcaagccgttctggagagtgcagtcctgttcctatgggttcatttccaagaagagggtttgtaaatggaagcagagaaagtactggatatttagaagaacttgagaaagaga

SEQ ID NO: 1434 - DNA, 121 bp, Homo sapiens
tctctttctcaagttcttctaaatatccagtactttctctgcttccatttacaaaccctcttcttggaaatgaacccataggaacaggactgcactctccagaacggcttgatacagatcc

SEQ ID NO: 1435 - DNA, 17 bp, Homo sapiens
ttccaagaagagggttt

SEQ ID NO: 1436 - DNA, 17 bp, Homo sapiens
aaaccctcttcttggaa

SEQ ID NO: 1437 - DNA, 121 bp, Homo sapiens
aaaaaaaaaataggtcattgcttcttgctgatcttgacaaagaagaaaaggaaaaagactggtattacgctcaacttcagaatctcactaaaagaatagatagtcttcctttaactgaaaa

SEQ ID NO: 1438 - DNA, 121 bp, Homo sapiens
ttttcagttaaaggaagactatctattcttttagtgagattctgaagttgagcgtaataccagtctttttccttttcttctttgtcaagatcagcaagaagcaatgacctatttttttttt

SEQ ID NO: 1439 - DNA, 17 bp, Homo sapiens
aaaagactggtattacg

SEQ ID NO: 1440 - DNA, 17 bp, Homo sapiens
cgtaataccagtctttt

SEQ ID NO: 1441 - DNA, 121 bp, Homo sapiens
aaataggtcattgcttcttgctgatcttgacaaagaagaaaaggaaaaagactggtattacgctcaacttcagaatctcactaaaagaatagatagtcttcctttaactgaaaatgtaagt

SEQ ID NO: 1442 - DNA, 121 bp, Homo sapiens
acttacattttcagttaaaggaagactatctattcttttagtgagattctgaagttgagcgtaataccagtctttttccttttcttctttgtcaagatcagcaagaagcaatgacctattt

SEQ ID NO: 1443 - DNA, 17 bp, Homo sapiens
tggtattacgctcaact

SEQ ID NO: 1444 - DNA, 17 bp, Homo sapiens
agttgagcgtaatacca

SEQ ID NO: 1445 - DNA, 121 bp, Homo sapiens
ttgcttcttgctgatcttgacaaagaagaaaaggaaaaagactggtattacgctcaacttcagaatctcactaaaagaatagatagtcttcctttaactgaaaatgtaagtaactggcagt

SEQ ID NO: 1446 - DNA, 121 bp, Homo sapiens
actgccagttacttacattttcagttaaaggaagactatctattcttttagtgagattctgaagttgagcgtaataccagtctttttccttttcttctttgtcaagatcagcaagaagcaa

SEQ ID NO: 1447 - DNA, 17 bp, Homo sapiens
ctcaacttcagaatctc

SEQ ID NO: 1448 - DNA, 17 bp, Homo sapiens
gagattctgaagttgag

SEQ ID NO: 1449 - DNA, 121 bp, Homo sapiens
cttgacaaagaagaaaaggaaaaagactggtattacgctcaacttcagaatctcactaaaagaatagatagtcttcctttaactgaaaatgtaagtaactggcagtacaacttatttgaaa

SEQ ID NO: 1450 - DNA, 121 bp, Homo sapiens
tttcaaataagttgtactgccagttacttacattttcagttaaaggaagactatctattcttttagtgagattctgaagttgagcgtaataccagtctttttccttttcttctttgtcaag

SEQ ID NO: 1451 - DNA, 17 bp, Homo sapiens
tcactaaaagaatagat

SEQ ID NO: 1452 - DNA, 17 bp, Homo sapiens
atctattcttttagtga

SEQ ID NO: 1453 - DNA, 121 bp, Homo sapiens
aagaaaaggaaaaagactggtattacgctcaacttcagaatctcactaaaagaatagatagtcttcctttaactgaaaatgtaagtaactggcagtacaacttatttgaaactttaataac

SEQ ID NO: 1454 - DNA, 121 bp, Homo sapiens
gttattaaagtttcaaataagttgtactgccagttacttacattttcagttaaaggaagactatctattcttttagtgagattctgaagttgagcgtaataccagtctttttccttttctt

SEQ ID NO: 1455 - DNA, 17 bp, Homo sapiens
aatagatagtcttcctt

SEQ ID NO: 1456 - DNA, 17 bp, Homo sapiens
aaggaagactatctatt

SEQ ID NO: 1457 - DNA, 121 bp, Homo sapiens
gattaacgtaaatacaagatattgatacttttttattatttgtggttttagttttccttacaaacagatatgaccagaaggcaattggaatatgaagcaaggcaaatcagagttgcgatgg

SEQ ID NO: 1458 - DNA, 121 bp, Homo sapiens
ccatcgcaactctgatttgccttgcttcatattccaattgccttctggtcatatctgtttgtaaggaaaactaaaaccacaaataataaaaaagtatcaatatcttgtatttacgttaatc

SEQ ID NO: 1459 - DNA, 17 bp, Homo sapiens
tttccttacaaacagat

SEQ ID NO: 1460 - DNA, 17 bp, Homo sapiens
atctgtttgtaaggaaa

SEQ ID NO: 1461 - DNA, 121 bp, Homo sapiens
cttttttattatttgtggttttagttttccttacaaacagatatgaccagaaggcaattggaatatgaagcaaggcaaatcagagttgcgatggaagaacaactaggtacctgccaggata

SEQ ID NO: 1462 - DNA, 121 bp, Homo sapiens
tatcctggcaggtacctagttgttcttccatcgcaactctgatttgccttgcttcatattccaattgccttctggtcatatctgtttgtaaggaaaactaaaaccacaaataataaaaaag

SEQ ID NO: 1463 - DNA, 17 bp, Homo sapiens
ggcaattggaatatgaa

SEQ ID NO: 1464 - DNA, 17 bp, Homo sapiens
ttcatattccaattgcc

SEQ ID NO: 1465 - DNA, 121 bp, Homo sapiens
caattggaatatgaagcaaggcaaatcagagttgcgatggaagaacaactaggtacctgccaggatatggaaaaacgagcacaggtaagttacttgtttctaagtgataaaacagcgaaga

SEQ ID NO: 1466 - DNA, 121 bp, Homo sapiens
tcttcgctgttttatcacttagaaacaagtaacttacctgtgctcgtttttccatatcctggcaggtacctagttgttcttccatcgcaactctgatttgccttgcttcatattccaattg

SEQ ID NO: 1467 - DNA, 17 bp, Homo sapiens
gtacctgccaggatatg

SEQ ID NO: 1468 - DNA, 17 bp, Homo sapiens
catatcctggcaggtac

SEQ ID NO: 1469 - DNA, 121 bp, Homo sapiens
gcaaggcaaatcagagttgcgatggaagaacaactaggtacctgccaggatatggaaaaacgagcacaggtaagttacttgtttctaagtgataaaacagcgaagagctattaggaataaa

SEQ ID NO: 1470 - DNA, 121 bp, Homo sapiens
tttattcctaatagctcttcgctgttttatcacttagaaacaagtaacttacctgtgctcgtttttccatatcctggcaggtacctagttgttcttccatcgcaactctgatttgccttgc

SEQ ID NO: 1471 - DNA, 17 bp, Homo sapiens
tggaaaaacgagcacag

SEQ ID NO: 1472 - DNA, 17 bp, Homo sapiens
ctgtgctcgtttttcca

SEQ ID NO: 1473 - DNA, 121 bp, Homo sapiens
gttttattttagcgaagaatagccagaattcagcaaatcgaaaaggacatacttcgtatacgacagcttttacagtcccaagcaacagaagcagaggttagtaaattgcctttcttgtttg

SEQ ID NO: 1474 - DNA, 121 bp, Homo sapiens
caaacaagaaaggcaatttactaacctctgcttctgttgcttgggactgtaaaagctgtcgtatacgaagtatgtccttttcgatttgctgaattctggctattcttcgctaaaataaaac

SEQ ID NO: 1475 - DNA, 17 bp, Homo sapiens
ttcgtatacgacagctt

SEQ ID NO: 1476 - DNA, 17 bp, Homo sapiens
aagctgtcgtatacgaa

SEQ ID NO: 1477 - DNA, 121 bp, Homo sapiens
ttattttagcgaagaatagccagaattcagcaaatcgaaaaggacatacttcgtatacgacagcttttacagtcccaagcaacagaagcagaggttagtaaattgcctttcttgtttgtgg

SEQ ID NO: 1478 - DNA, 121 bp, Homo sapiens
ccacaaacaagaaaggcaatttactaacctctgcttctgttgcttgggactgtaaaagctgtcgtatacgaagtatgtccttttcgatttgctgaattctggctattcttcgctaaaataa

SEQ ID NO: 1479 - DNA, 17 bp, Homo sapiens
gtatacgacagctttta

SEQ ID NO: 1480 - DNA, 17 bp, Homo sapiens
taaaagctgtcgtatac

SEQ ID NO: 1481 - DNA, 121 bp, Homo sapiens
agaaagcctacaccatttttgcatgtactgatgttaactccatcttaacagaggtcatctcagaacaagcatgaaaccggctcacatgatgctgagcggcagaatgaaggtcaaggagtgg

SEQ ID NO: 1482 - DNA, 121 bp, Homo sapiens
ccactccttgaccttcattctgccgctcagcatcatgtgagccggtttcatgcttgttctgagatgacctctgttaagatggagttaacatcagtacatgcaaaaatggtgtaggctttct

SEQ ID NO: 1483 - DNA, 17 bp, Homo sapiens
ggtcatctcagaacaag

SEQ ID NO: 1484 - DNA, 17 bp, Homo sapiens
cttgttctgagatgacc

SEQ ID NO: 1485 - DNA, 121 bp, Homo sapiens
cagaacaagcatgaaaccggctcacatgatgctgagcggcagaatgaaggtcaaggagtgggagaaatcaacatggcaacttctggtaatggtcaggtaaataaattattttatcatattt

SEQ ID NO: 1486 - DNA, 121 bp, Homo sapiens
aaatatgataaaataatttatttacctgaccattaccagaagttgccatgttgatttctcccactccttgaccttcattctgccgctcagcatcatgtgagccggtttcatgcttgttctg

SEQ ID NO: 1487 - DNA, 17 bp, Homo sapiens
aaggagtgggagaaatc

SEQ ID NO: 1488 - DNA, 17 bp, Homo sapiens
gatttctcccactcctt

SEQ ID NO: 1489 - DNA, 121 bp, Homo sapiens
cttcaaataacaaagcattatggtttatgttgattttatttttcagtgccagctcctgttgaacatcagatctgtcctgctgtgtgtgttctaatgaaactttcatttgatgaagagcata

SEQ ID NO: 1490 - DNA, 121 bp, Homo sapiens
tatgctcttcatcaaatgaaagtttcattagaacacacacagcaggacagatctgatgttcaacaggagctggcactgaaaaataaaatcaacataaaccataatgctttgttatttgaag

SEQ ID NO: 1491 - DNA, 17 bp, Homo sapiens
ctcctgttgaacatcag

SEQ ID NO: 1492 - DNA, 17 bp, Homo sapiens
ctgatgttcaacaggag

SEQ ID NO: 1493 - DNA, 121 bp, Homo sapiens
cagtgccagctcctgttgaacatcagatctgtcctgctgtgtgtgttctaatgaaactttcatttgatgaagagcatagacatgcaatgaatgaactaggtaagacaaaaatgttttttaa

SEQ ID NO: 1494 - DNA, 121 bp, Homo sapiens
ttaaaaaacatttttgtcttacctagttcattcattgcatgtctatgctcttcatcaaatgaaagtttcattagaacacacacagcaggacagatctgatgttcaacaggagctggcactg

SEQ ID NO: 1495 - DNA, 17 bp, Homo sapiens
gaaactttcatttgatg

SEQ ID NO: 1496 - DNA, 17 bp, Homo sapiens
catcaaatgaaagtttc

SEQ ID NO: 1497 - DNA, 121 bp, Homo sapiens
agttgttttattttagatgattgtctttttcctcttgccctttttaaattagggggactacaggccattgcagaattattgcaagtggactgtgaaatgtacgggcttactaatgaccact

SEQ ID NO: 1498 - DNA, 121 bp, Homo sapiens
agtggtcattagtaagcccgtacatttcacagtccacttgcaataattctgcaatggcctgtagtccccctaatttaaaaagggcaagaggaaaaagacaatcatctaaaataaaacaact

SEQ ID NO: 1499 - DNA, 17 bp, Homo sapiens
ggggactacaggccatt

SEQ ID NO: 1500 - DNA, 17 bp, Homo sapiens
aatggcctgtagtcccc

SEQ ID NO: 1501 - DNA, 121 bp, Homo sapiens
ttttaaattagggggactacaggccattgcagaattattgcaagtggactgtgaaatgtacgggcttactaatgaccactacagtattacactaagacgatatgctggaatggctttgaca

SEQ ID NO: 1502 - DNA, 121 bp, Homo sapiens
tgtcaaagccattccagcatatcgtcttagtgtaatactgtagtggtcattagtaagcccgtacatttcacagtccacttgcaataattctgcaatggcctgtagtccccctaatttaaaa

SEQ ID NO: 1503 - DNA, 17 bp, Homo sapiens
gaaatgtacgggcttac

SEQ ID NO: 1504 - DNA, 17 bp, Homo sapiens
gtaagcccgtacatttc

SEQ ID NO: 1505 - DNA, 121 bp, Homo sapiens
ttgcaagtggactgtgaaatgtatgggcttactaatgaccactacagtattacactaagacgatatgctggaatggctttgacaaacttgacttttggagatgtagccaacaaggtatgtt

SEQ ID NO: 1506 - DNA, 121 bp, Homo sapiens
aacataccttgttggctacatctccaaaagtcaagtttgtcaaagccattccagcatatcgtcttagtgtaatactgtagtggtcattagtaagcccatacatttcacagtccacttgcaa

SEQ ID NO: 1507 - DNA, 17 bp, Homo sapiens
cactaagacgatatgct

SEQ ID NO: 1508 - DNA, 17 bp, Homo sapiens
agcatatcgtcttagtg

SEQ ID NO: 1509 - DNA, 121 bp, Homo sapiens
agtggactgtgaaatgtatgggcttactaatgaccactacagtattacactaagacgatatgctggaatggctttgacaaacttgacttttggagatgtagccaacaaggtatgtttttat

SEQ ID NO: 1510 - DNA, 121 bp, Homo sapiens
ataaaaacataccttgttggctacatctccaaaagtcaagtttgtcaaagccattccagcatatcgtcttagtgtaatactgtagtggtcattagtaagcccatacatttcacagtccact

SEQ ID NO: 1511 - DNA, 17 bp, Homo sapiens
agacgatatgctggaat

SEQ ID NO: 1512 - DNA, 17 bp, Homo sapiens
attccagcatatcgtct

SEQ ID NO: 1513 - DNA, 121 bp, Homo sapiens
gacaaattccaactctaattagatgacccatattctgtttcttactaggaatcaaccctcaaaagcgtattgagtgccttatggaatttgtcagcacattgcactgagaataaagctgata

SEQ ID NO: 1514 - DNA, 121 bp, Homo sapiens
tatcagctttattctcagtgcaatgtgctgacaaattccataaggcactcaatacgcttttgagggttgattcctagtaagaaacagaatatgggtcatctaattagagttggaatttgtc

SEQ ID NO: 1515 - DNA, 17 bp, Homo sapiens
caaccctcaaaagcgta

SEQ ID NO: 1516 - DNA, 17 bp, Homo sapiens
tacgcttttgagggttg

SEQ ID NO: 1517 - DNA, 121 bp, Homo sapiens
tagatgacccatattctgtttcttactaggaatcaaccctcaaaagcgtattgagtgccttatggaatttgtcagcacattgcactgagaataaagctgatatatgtgctgtagatggtgc

SEQ ID NO: 1518 - DNA, 121 bp, Homo sapiens
gcaccatctacagcacatatatcagctttattctcagtgcaatgtgctgacaaattccataaggcactcaatacgcttttgagggttgattcctagtaagaaacagaatatgggtcatcta

SEQ ID NO: 1519 - DNA, 17 bp, Homo sapiens
gagtgccttatggaatt

SEQ ID NO: 1520 - DNA, 17 bp, Homo sapiens
aattccataaggcactc

SEQ ID NO: 1521 - DNA, 121 bp, Homo sapiens
atgacccatattctgtttcttactaggaatcaaccctcaaaagcgtattgagtgccttatggaatttgtcagcacattgcactgagaataaagctgatatatgtgctgtagatggtgcact

SEQ ID NO: 1522 - DNA, 121 bp, Homo sapiens
agtgcaccatctacagcacatatatcagctttattctcagtgcaatgtgctgacaaattccataaggcactcaatacgcttttgagggttgattcctagtaagaaacagaatatgggtcat

SEQ ID NO: 1523 - DNA, 17 bp, Homo sapiens
tgccttatggaatttgt

SEQ ID NO: 1524 - DNA, 17 bp, Homo sapiens
acaaattccataaggca

SEQ ID NO: 1525 - DNA, 121 bp, Homo sapiens
tgacccatattctgtttcttactaggaatcaaccctcaaaagcgtattgagtgccttatggaatttgtcagcacattgcactgagaataaagctgatatatgtgctgtagatggtgcactt

SEQ ID NO: 1526 - DNA, 121 bp, Homo sapiens
aagtgcaccatctacagcacatatatcagctttattctcagtgcaatgtgctgacaaattccataaggcactcaatacgcttttgagggttgattcctagtaagaaacagaatatgggtca

SEQ ID NO: 1527 - DNA, 17 bp, Homo sapiens
gccttatggaatttgtc

SEQ ID NO: 1528 - DNA, 17 bp, Homo sapiens
gacaaattccataaggc

SEQ ID NO: 1529 - DNA, 121 bp, Homo sapiens
taaagctgatatatgtgctgtagatggtgcacttgcatttttggttggcactcttacttaccggagccagacaaacactttagccattattgaaagtggaggtgggatattacggaatgtg

SEQ ID NO: 1530 - DNA, 121 bp, Homo sapiens
cacattccgtaatatcccacctccactttcaataatggctaaagtgtttgtctggctccggtaagtaagagtgccaaccaaaaatgcaagtgcaccatctacagcacatatatcagcttta

SEQ ID NO: 1531 - DNA, 17 bp, Homo sapiens
cttacttaccggagcca

SEQ ID NO: 1532 - DNA, 17 bp, Homo sapiens
tggctccggtaagtaag

SEQ ID NO: 1533 - DNA, 121 bp, Homo sapiens
gatatatgtgctgtagatggtgcacttgcatttttggttggcactcttacttaccggagccagacaaacactttagccattattgaaagtggaggtgggatattacggaatgtgtccagct

SEQ ID NO: 1534 - DNA, 121 bp, Homo sapiens
agctggacacattccgtaatatcccacctccactttcaataatggctaaagtgtttgtctggctccggtaagtaagagtgccaaccaaaaatgcaagtgcaccatctacagcacatatatc

SEQ ID NO: 1535 - DNA, 17 bp, Homo sapiens
accggagccagacaaac

SEQ ID NO: 1536 - DNA, 17 bp, Homo sapiens
gtttgtctggctccggt

SEQ ID NO: 1537 - DNA, 121 bp, Homo sapiens
tagatggtgcacttgcatttttggttggcactcttacttaccggagccagacaaacactttagccattattgaaagtggaggtgggatattacggaatgtgtccagcttgatagctacaaa

SEQ ID NO: 1538 - DNA, 121 bp, Homo sapiens
tttgtagctatcaagctggacacattccgtaatatcccacctccactttcaataatggctaaagtgtttgtctggctccggtaagtaagagtgccaaccaaaaatgcaagtgcaccatcta

SEQ ID NO: 1539 - DNA, 17 bp, Homo sapiens
aaacactttagccatta

SEQ ID NO: 1540 - DNA, 17 bp, Homo sapiens
taatggctaaagtgttt

SEQ ID NO: 1541 - DNA, 121 bp, Homo sapiens
gccattattgaaagtggaggtgggatattacggaatgtgtccagcttgatagctacaaatgaggaccacaggtatatatagagttttatattacttttaaagtacagaattcatactctca

SEQ ID NO: 1542 - DNA, 121 bp, Homo sapiens
tgagagtatgaattctgtactttaaaagtaatataaaactctatatatacctgtggtcctcatttgtagctatcaagctggacacattccgtaatatcccacctccactttcaataatggc

SEQ ID NO: 1543 - DNA, 17 bp, Homo sapiens
ctacaaatgaggaccac

SEQ ID NO: 1544 - DNA, 17 bp, Homo sapiens
gtggtcctcatttgtag

SEQ ID NO: 1545 - DNA, 121 bp, Homo sapiens
tgcatgtggaactttgtggaatctctcagcaagaaatcctaaagaccaggaagcattatgggacatgggggcagttagcatgctcaagaacctcattcattcaaagcacaaaatgattgct

SEQ ID NO: 1546 - DNA, 121 bp, Homo sapiens
agcaatcattttgtgctttgaatgaatgaggttcttgagcatgctaactgcccccatgtcccataatgcttcctggtctttaggatttcttgctgagagattccacaaagttccacatgca

SEQ ID NO: 1547 - DNA, 17 bp, Homo sapiens
gcattatgggacatggg

SEQ ID NO: 1548 - DNA, 17 bp, Homo sapiens
cccatgtcccataatgc

SEQ ID NO: 1549 - DNA, 121 bp, Homo sapiens
aagaccaggaagcattatgggacatgggggcagttagcatgctcaagaacctcattcattcaaagcacaaaatgattgctatgggaagtgctgcagctttaaggaatctcatggcaaatag

SEQ ID NO: 1550 - DNA, 121 bp, Homo sapiens
ctatttgccatgagattccttaaagctgcagcacttcccatagcaatcattttgtgctttgaatgaatgaggttcttgagcatgctaactgcccccatgtcccataatgcttcctggtctt

SEQ ID NO: 1551 - DNA, 17 bp, Homo sapiens
cattcattcaaagcaca

SEQ ID NO: 1552 - DNA, 17 bp, Homo sapiens
tgtgctttgaatgaatg

SEQ ID NO: 1553 - DNA, 121 bp, Homo sapiens
ggggcagttagcatgctcaagaacctcattcattcaaagcacaaaatgattgctatgggaagtgctgcagctttaaggaatctcatggcaaataggcctgcgaagtacaaggatgccaata

SEQ ID NO: 1554 - DNA, 121 bp, Homo sapiens
tattggcatccttgtacttcgcaggcctatttgccatgagattccttaaagctgcagcacttcccatagcaatcattttgtgctttgaatgaatgaggttcttgagcatgctaactgcccc

SEQ ID NO: 1555 - DNA, 17 bp, Homo sapiens
ctatgggaagtgctgca

SEQ ID NO: 1556 - DNA, 17 bp, Homo sapiens
tgcagcacttcccatag

SEQ ID NO: 1557 - DNA, 121 bp, Homo sapiens
tctcctggctcagcttgccatctcttcatgttaggaaacaaaaagccctagaagcagaattagatgctcagcacttatcagaaacttttgacaatatagacaatttaagtcccaaggcatc

SEQ ID NO: 1558 - DNA, 121 bp, Homo sapiens
gatgccttgggacttaaattgtctatattgtcaaaagtttctgataagtgctgagcatctaattctgcttctagggctttttgtttcctaacatgaagagatggcaagctgagccaggaga

SEQ ID NO: 1559 - DNA, 17 bp, Homo sapiens
agcagaattagatgctc

SEQ ID NO: 1560 - DNA, 17 bp, Homo sapiens
gagcatctaattctgct

SEQ ID NO: 1561 - DNA, 121 bp, Homo sapiens
ttagatgctcagcacttatcagaaacttttgacaatatagacaatttaagtcccaaggcatctcatcgtagtaagcagagacacagcaagtctctatggtgattatgtttttgacaccatc

SEQ ID NO: 1562 - DNA, 121 bp, Homo sapiens
gatggtgtcaaaaacataatcaccatagagacttgctgtgtctctgcttactacgatgagatgccttgggacttaaattgtctatattgtcaaaagtttctgataagtgctgagcatctaa

SEQ ID NO: 1563 - DNA, 17 bp, Homo sapiens
ccaaggcatctcatcgt

SEQ ID NO: 1564 - DNA, 17 bp, Homo sapiens
acgatgagatgccttgg

SEQ ID NO: 1565 - DNA, 121 bp, Homo sapiens
ctcatcgtagtaagcagagacacagcaagtctctatggtgattatgtttttgacaccaatcgacatgatgataataggtcagacattttaatactggcacatgactgtcctttcaccatat

SEQ ID NO: 1566 - DNA, 121 bp, Homo sapiens
atatggtgaaaggacagtcatgtgccagtattaaaatgtctgacctattatcatcatgtcgattggtgtcaaaaacataatcaccatagagacttgctgtgtctctgcttactacgatgag

SEQ ID NO: 1567 - DNA, 17 bp, Homo sapiens
acaccaatcgacatgat

SEQ ID NO: 1568 - DNA, 17 bp, Homo sapiens
atcatgtcgattggtgt

SEQ ID NO: 1569 - DNA, 121 bp, Homo sapiens
ggtctaggcaactaccatccagcaacagaaaatccaggaacttcttcaaagcgaggtttgcagatctccaccactgcagcccagattgccaaagtcatggaagaagtgtcagccattcata

SEQ ID NO: 1570 - DNA, 121 bp, Homo sapiens
tatgaatggctgacacttcttccatgactttggcaatctgggctgcagtggtggagatctgcaaacctcgctttgaagaagttcctggattttctgttgctggatggtagttgcctagacc

SEQ ID NO: 1571 - DNA, 17 bp, Homo sapiens
gaggtttgcagatctcc

SEQ ID NO: 1572 - DNA, 17 bp, Homo sapiens
ggagatctgcaaacctc

SEQ ID NO: 1573 - DNA, 121 bp, Homo sapiens
tacattgtgtgacagatgagagaaatgcacttagaagaagctctgctgcccatacacattcaaacacttacaatttcactaagtcggaaaattcaaataggacatgttctatgccttatgc

SEQ ID NO: 1574 - DNA, 121 bp, Homo sapiens
gcataaggcatagaacatgtcctatttgaattttccgacttagtgaaattgtaagtgtttgaatgtgtatgggcagcagagcttcttctaagtgcatttctctcatctgtcacacaatgta

SEQ ID NO: 1575 - DNA, 17 bp, Homo sapiens
tacacattcaaacactt

SEQ ID NO: 1576 - DNA, 17 bp, Homo sapiens
aagtgtttgaatgtgta

SEQ ID NO: 1577 - DNA, 121 bp, Homo sapiens; identical to SEQ ID NO: 1573

SEQ ID NO: 1578 - DNA, 121 bp, Homo sapiens; identical to SEQ ID NO: 1574

SEQ ID NO: 1579 - DNA, 17 bp, Homo sapiens
tacacattcaaacactt

SEQ ID NO: 1580 - DNA, 17 bp, Homo sapiens
aagtgtttgaatgtgta

SEQ ID NO: 1581 - DNA, 121 bp, Homo sapiens
gacagatgagagaaatgcacttagaagaagctctgctgcccatacacattcaaacacttacaatttcactaagtcggaaaattcaaataggacatgttctatgccttatgccaaattagaa

SEQ ID NO: 1582 - DNA, 121 bp, Homo sapiens
ttctaatttggcataaggcatagaacatgtcctatttgaattttccgacttagtgaaattgtaagtgtttgaatgtgtatgggcagcagagcttcttctaagtgcatttctctcatctgtc

SEQ ID NO: 1583 - DNA, 17 bp, Homo sapiens
aacacttacaatttcac

SEQ ID NO: 1584 - DNA, 17 bp, Homo sapiens
gtgaaattgtaagtgtt

SEQ ID NO: 1585 - DNA, 121 bp, Homo sapiens; identical to SEQ ID NO: 1581

SEQ ID NO: 1586 - DNA, 121 bp, Homo sapiens; identical to SEQ ID NO: 1582

SEQ ID NO: 1587 - DNA, 17 bp, Homo sapiens
aacacttacaatttcac

SEQ ID NO: 1588 - DNA, 17 bp, Homo sapiens
gtgaaattgtaagtgtt

SEQ ID NO: 1589 - DNA, 121 bp, Homo sapiens
accctcgattgaatcctattctgaagatgatgaaagtaagttttgcagttatggtcaatacccagccgacctagcccataaaatacatagtgcaaatcatatggatgataatgatggagaa

SEQ ID NO: 1590 - DNA, 121 bp, Homo sapiens
ttctccatcattatcatccatatgatttgcactatgtattttatgggctaggtcggctgggtattgaccataactgcaaaacttactttcatcatcttcagaataggattcaatcgagggt

SEQ ID NO: 1591 - DNA, 17 bp, Homo sapiens
ggtcaatacccagccga

SEQ ID NO: 1592 - DNA, 17 bp, Homo sapiens
tcggctgggtattgacc

SEQ ID NO: 1593 - DNA, 121 bp, Homo sapiens
tacccagccgacctagcccataaaatacatagtgcaaatcatatggatgataatgatggagaactagatacaccaataaattatagtcttaaatattcagatgagcagttgaactctggaa

SEQ ID NO: 1594 - DNA, 121 bp, Homo sapiens
ttccagagttcaactgctcatctgaatatttaagactataatttattggtgtatctagttctccatcattatcatccatatgatttgcactatgtattttatgggctaggtcggctgggta

SEQ ID NO: 1595 - DNA, 17 bp, Homo sapiens
atgatggagaactagat

SEQ ID NO: 1596 - DNA, 17 bp, Homo sapiens
atctagttctccatcat

SEQ ID NO: 1597 - DNA, 121 bp, Homo sapiens
atgaaaccctcgattgaatcctattctgaagatgatgaaagtaagttttgcagttatggtcaatacccagccgacctagcccataaaatacatagtgcaaatcatatggatgataatgatg

SEQ ID NO: 1598 - DNA, 121 bp, Homo sapiens
catcattatcatccatatgatttgcactatgtattttatgggctaggtcggctgggtattgaccataactgcaaaacttactttcatcatcttcagaataggattcaatcgagggtttcat

SEQ ID NO: 1599 - DNA, 17 bp, Homo sapiens
gttatggtcaataccca

SEQ ID NO: 1600 - DNA, 17 bp, Homo sapiens
tgggtattgaccataac

SEQ ID NO: 1601 - DNA, 121 bp, Homo sapiens
tgaagatgatgaaagtaagttttgcagttatggtcaatacccagccgacctagcccataaaatacatagtgcaaatcatatggatgataatgatggagaactagatacaccaataaattat

SEQ ID NO: 1602 - DNA, 121 bp, Homo sapiens
ataatttattggtgtatctagttctccatcattatcatccatatgatttgcactatgtattttatgggctaggtcggctgggtattgaccataactgcaaaacttactttcatcatcttca

SEQ ID NO: 1603 - DNA, 17 bp, Homo sapiens
gcccataaaatacatag

SEQ ID NO: 1604 - DNA, 17 bp, Homo sapiens
ctatgtattttatgggc

SEQ ID NO: 1605 - DNA, 121 bp, Homo sapiens
ataaattatagtcttaaatattcagatgagcagttgaactctggaaggcaaagtccttcacagaatgaaagatgggcaagacccaaacacataatagaagatgaaataaaacaaagtgagc

SEQ ID NO: 1606 - DNA, 121 bp, Homo sapiens
gctcactttgttttatttcatcttctattatgtgtttgggtcttgcccatctttcattctgtgaaggactttgccttccagagttcaactgctcatctgaatatttaagactataatttat

SEQ ID NO: 1607 - DNA, 17 bp, Homo sapiens
gtccttcacagaatgaa

SEQ ID NO: 1608 - DNA, 17 bp, Homo sapiens
ttcattctgtgaaggac

SEQ ID NO: 1609 - DNA, 121 bp, Homo sapiens
gaaagatgggcaagacccaaacacataatagaagatgaaataaaacaaagtgagcaaagacaatcaaggaatcaaagtacaacttatcctgtttatactgagagcactgatgataaacacc

SEQ ID NO: 1610 - DNA, 121 bp, Homo sapiens
ggtgtttatcatcagtgctctcagtataaacaggataagttgtactttgattccttgattgtctttgctcactttgttttatttcatcttctattatgtgtttgggtcttgcccatctttc

SEQ ID NO: 1611 - DNA, 17 bp, Homo sapiens
agcaaagacaatcaagg

SEQ ID NO: 1612 - DNA, 17 bp, Homo sapiens
ccttgattgtctttgct

SEQ ID NO: 1613 - DNA, 121 bp, Homo sapiens
aatagaagatgaaataaaacaaagtgagcaaagacaatcaaggaatcaaagtacaacttatcctgtttatactgagagcactgatgataaacacctcaagttccaaccacattttggacag

SEQ ID NO: 1614 - DNA, 121 bp, Homo sapiens
ctgtccaaaatgtggttggaacttgaggtgtttatcatcagtgctctcagtataaacaggataagttgtactttgattccttgattgtctttgctcactttgttttatttcatcttctatt

SEQ ID NO: 1615 - DNA, 17 bp, Homo sapiens
acaacttatcctgttta

SEQ ID NO: 1616 - DNA, 17 bp, Homo sapiens
taaacaggataagttgt

SEQ ID NO: 1617 - DNA, 121 bp, Homo sapiens
tgatgataaacacctcaagttccaaccacattttggacagcaggaatgtgtttctccatacaggtcacggggagccaatggttcagaaacaaatcgagtgggttctaatcatggaattaat

SEQ ID NO: 1618 - DNA, 121 bp, Homo sapiens
attaattccatgattagaacccactcgatttgtttctgaaccattggctccccgtgacctgtatggagaaacacattcctgctgtccaaaatgtggttggaacttgaggtgtttatcatca

SEQ ID NO: 1619 - DNA, 17 bp, Homo sapiens
tctccatacaggtcacg

SEQ ID NO: 1620 - DNA, 17 bp, Homo sapiens
cgtgacctgtatggaga

SEQ ID NO: 1621 - DNA, 121 bp, Homo sapiens
aaccacattttggacagcaggaatgtgtttctccatacaggtcacggggagccaatggttcagaaacaaatcgagtgggttctaatcatggaattaatcaaaatgtaagccagtctttgtg

SEQ ID NO: 1622 - DNA, 121 bp, Homo sapiens
cacaaagactggcttacattttgattaattccatgattagaacccactcgatttgtttctgaaccattggctccccgtgacctgtatggagaaacacattcctgctgtccaaaatgtggtt

SEQ ID NO: 1623 - DNA, 17 bp, Homo sapiens
caatggttcagaaacaa

SEQ ID NO: 1624 - DNA, 17 bp, Homo sapiens
ttgtttctgaaccattg

SEQ ID NO: 1625 - DNA, 121 bp, Homo sapiens
ggacagcaggaatgtgtttctccatacaggtcacggggagccaatggttcagaaacaaatcgagtgggttctaatcatggaattaatcaaaatgtaagccagtctttgtgtcaagaagatg

SEQ ID NO: 1626 - DNA, 121 bp, Homo sapiens
catcttcttgacacaaagactggcttacattttgattaattccatgattagaacccactcgatttgtttctgaaccattggctccccgtgacctgtatggagaaacacattcctgctgtcc

SEQ ID NO: 1627 - DNA, 17 bp, Homo sapiens
aaacaaatcgagtgggt

SEQ ID NO: 1628 - DNA, 17 bp, Homo sapiens
acccactcgatttgttt

SEQ ID NO: 1629 - DNA, 121 bp, Homo sapiens
gggttctaatcatggaattaatcaaaatgtaagccagtctttgtgtcaagaagatgactatgaagatgataagcctaccaattatagtgaacgttactctgaagaagaacagcatgaagaa

SEQ ID NO: 1630 - DNA, 121 bp, Homo sapiens
ttcttcatgctgttcttcttcagagtaacgttcactataattggtaggcttatcatcttcatagtcatcttcttgacacaaagactggcttacattttgattaattccatgattagaaccc

SEQ ID NO: 1631 - DNA, 17 bp, Homo sapiens
gatgactatgaagatga

SEQ ID NO: 1632 - DNA, 17 bp, Homo sapiens
tcatcttcatagtcatc

SEQ ID NO: 1633 - DNA, 121 bp, Homo sapiens
gaagatgactatgaagatgataagcctaccaattatagtgaacgttactctgaagaagaacagcatgaagaagaagagagaccaacaaattatagcataaaatataatgaagagaaacgtc

SEQ ID NO: 1634 - DNA, 121 bp, Homo sapiens
gacgtttctcttcattatattttatgctataatttgttggtctctcttcttcttcatgctgttcttcttcagagtaacgttcactataattggtaggcttatcatcttcatagtcatcttc

SEQ ID NO: 1635 - DNA, 17 bp, Homo sapiens
aagaagaacagcatgaa

SEQ ID NO: 1636 - DNA, 17 bp, Homo sapiens
ttcatgctgttcttctt

SEQ ID NO: 1637 - DNA, 121 bp, Homo sapiens
gaagaagagagaccaacaaattatagcataaaatataatgaagagaaacgtcatgtggatcagcctattgattatagtttaaaatatgccacagatattccttcatcacagaaacagtcat

SEQ ID NO: 1638 - DNA, 121 bp, Homo sapiens
atgactgtttctgtgatgaaggaatatctgtggcatattttaaactataatcaataggctgatccacatgacgtttctcttcattatattttatgctataatttgttggtctctcttcttc

SEQ ID NO: 1639 - DNA, 17 bp, Homo sapiens
atgtggatcagcctatt

SEQ ID NO: 1640 - DNA, 17 bp, Homo sapiens
aataggctgatccacat

SEQ ID NO: 1641 - DNA, 121 bp, Homo sapiens
aagagagaccaacaaattatagcataaaatataatgaagagaaacgtcatgtggatcagcctattgattatagtttaaaatatgccacagatattccttcatcacagaaacagtcattttc

SEQ ID NO: 1642 - DNA, 121 bp, Homo sapiens
gaaaatgactgtttctgtgatgaaggaatatctgtggcatattttaaactataatcaataggctgatccacatgacgtttctcttcattatattttatgctataatttgttggtctctctt

SEQ ID NO: 1643 - DNA, 17 bp, Homo sapiens
ggatcagcctattgatt

SEQ ID NO: 1644 - DNA, 17 bp, Homo sapiens
aatcaataggctgatcc

SEQ ID NO: 1645 - DNA, 121 bp, Homo sapiens
ataaaatataatgaagagaaacgtcatgtggatcagcctattgattatagtttaaaatatgccacagatattccttcatcacagaaacagtcattttcattctcaaagagttcatctggac

SEQ ID NO: 1646 - DNA, 121 bp, Homo sapiens
gtccagatgaactctttgagaatgaaaatgactgtttctgtgatgaaggaatatctgtggcatattttaaactataatcaataggctgatccacatgacgtttctcttcattatattttat

SEQ ID NO: 1647 - DNA, 17 bp, Homo sapiens
taaaatatgccacagat

SEQ ID NO: 1648 - DNA, 17 bp, Homo sapiens
atctgtggcatatttta

SEQ ID NO: 1649 - DNA, 121 bp, Homo sapiens
atcagcctattgattatagtttaaaatatgccacagatattccttcatcacagaaacagtcattttcattctcaaagagttcatctggacaaagcagtaaaaccgaacatatgtcttcaag

SEQ ID NO: 1650 - DNA, 121 bp, Homo sapiens
cttgaagacatatgttcggttttactgctttgtccagatgaactctttgagaatgaaaatgactgtttctgtgatgaaggaatatctgtggcatattttaaactataatcaataggctgat

SEQ ID NO: 1651 - DNA, 17 bp, Homo sapiens
gaaacagtcattttcat

SEQ ID NO: 1652 - DNA, 17 bp, Homo sapiens
atgaaaatgactgtttc

SEQ ID NO: 1653 - DNA, 121 bp, Homo sapiens
attatagtttaaaatatgccacagatattccttcatcacagaaacagtcattttcattctcaaagagttcatctggacaaagcagtaaaaccgaacatatgtcttcaagcagtgagaatac

SEQ ID NO: 1654 - DNA, 121 bp, Homo sapiens
gtattctcactgcttgaagacatatgttcggttttactgctttgtccagatgaactctttgagaatgaaaatgactgtttctgtgatgaaggaatatctgtggcatattttaaactataat

SEQ ID NO: 1655 - DNA, 17 bp, Homo sapiens
ttcattctcaaagagtt

SEQ ID NO: 1656 - DNA, 17 bp, Homo sapiens
aactctttgagaatgaa

SEQ ID NO: 1657 - DNA, 121 bp, Homo sapiens
accgaacatatgtcttcaagcagtgagaatacgtccacaccttcatctaatgccaagaggcagaatcagctccatccagttctgcacagagtagaagtggtcagcctcaaaggctgccact

SEQ ID NO: 1658 - DNA, 121 bp, Homo sapiens
agtggcagcctttgaggctgaccacttctactctgtgcagaactggatggagctgattctgcctcttggcattagatgaaggtgtggacgtattctcactgcttgaagacatatgttcggt

SEQ ID NO: 1659 - DNA, 17 bp, Homo sapiens
ccaagaggcagaatcag

SEQ ID NO: 1660 - DNA, 17 bp, Homo sapiens
ctgattctgcctcttgg

SEQ ID NO: 1661 - DNA, 121 bp, Homo sapiens
catatgtcttcaagcagtgagaatacgtccacaccttcatctaatgccaagaggcagaatcagctccatccagttctgcacagagtagaagtggtcagcctcaaaggctgccacttgcaag

SEQ ID NO: 1662 - DNA, 121 bp, Homo sapiens
cttgcaagtggcagcctttgaggctgaccacttctactctgtgcagaactggatggagctgattctgcctcttggcattagatgaaggtgtggacgtattctcactgcttgaagacatatg

SEQ ID NO: 1663 - DNA, 17 bp, Homo sapiens
ggcagaatcagctccat

SEQ ID NO: 1664 - DNA, 17 bp, Homo sapiens
atggagctgattctgcc

SEQ ID NO: 1665 - DNA, 121 bp, Homo sapiens
tcagctccatccaagttctgcacagagtagaagtggtcagcctcaaaaggctgccacttgcaaagtttcttctattaaccaagaaacaatacagacttattgtgtagaagatactccaata

SEQ ID NO: 1666 - DNA, 121 bp, Homo sapiens
tattggagtatcttctacacaataagtctgtattgtttcttggttaatagaagaaactttgcaagtggcagccttttgaggctgaccacttctactctgtgcagaacttggatggagctga

SEQ ID NO: 1667 - DNA, 17 bp, Homo sapiens
gccacttgcaaagtttc

SEQ ID NO: 1668 - DNA, 17 bp, Homo sapiens
gaaactttgcaagtggc

SEQ ID NO: 1669 - DNA, 121 bp, Homo sapiens
agtttcttctattaaccaagaaacaatacagacttattgtgtagaagatactccaatatgtttttcaagatgtagttcattatcatctttgtcatcagctgaagatgaaataggatgtaat

SEQ ID NO: 1670 - DNA, 121 bp, Homo sapiens
attacatcctatttcatcttcagctgatgacaaagatgataatgaactacatcttgaaaaacatattggagtatcttctacacaataagtctgtattgtttcttggttaatagaagaaact

SEQ ID NO: 1671 - DNA, 17 bp, Homo sapiens
ccaatatgtttttcaag

SEQ ID NO: 1672 - DNA, 17 bp, Homo sapiens
cttgaaaaacatattgg

SEQ ID NO: 1673 - DNA, 121 bp, Homo sapiens
aagaaacaatacagacttattgtgtagaagatactccaatatgtttttcaagatgtagttcattatcatctttgtcatcagctgaagatgaaataggatgtaatcagacgacacaggaagc

SEQ ID NO: 1674 - DNA, 121 bp, Homo sapiens
gcttcctgtgtcgtctgattacatcctatttcatcttcagctgatgacaaagatgataatgaactacatcttgaaaaacatattggagtatcttctacacaataagtctgtattgtttctt

SEQ ID NO: 1675 - DNA, 17 bp, Homo sapiens
atgtagttcattatcat

SEQ ID NO: 1676 - DNA, 17 bp, Homo sapiens
atgataatgaactacat

SEQ ID NO: 1677 - DNA, 121 bp, Homo sapiens
gatactccaatatgtttttcaagatgtagttcattatcatctttgtcatcagctgaagatgaaataggatgtaatcagacgacacaggaagcagattctgctaataccctgcaaatagcag

SEQ ID NO: 1678 - DNA, 121 bp, Homo sapiens
ctgctatttgcagggtattagcagaatctgcttcctgtgtcgtctgattacatcctatttcatcttcagctgatgacaaagatgataatgaactacatcttgaaaaacatattggagtatc

SEQ ID NO: 1679 - DNA, 17 bp, Homo sapiens
ctgaagatgaaatagga

SEQ ID NO: 1680 - DNA, 17 bp, Homo sapiens
tcctatttcatcttcag

SEQ ID NO: 1681 - DNA, 121 bp, Homo sapiens
tgtagttcattatcatctttgtcatcagctgaagatgaaataggatgtaatcagacgacacaggaagcagattctgctaataccctgcaaatagcagaaataaaagaaaagattggaacta

SEQ ID NO: 1682 - DNA, 121 bp, Homo sapiens
tagttccaatcttttcttttatttctgctatttgcagggtattagcagaatctgcttcctgtgtcgtctgattacatcctatttcatcttcagctgatgacaaagatgataatgaactaca

SEQ ID NO: 1683 - DNA, 17 bp, Homo sapiens
agacgacacaggaagca

SEQ ID NO: 1684 - DNA, 17 bp, Homo sapiens
tgcttcctgtgtcgtct

SEQ ID NO: 1685 - DNA, 121 bp, Homo sapiens
taggatgtaatcagacgacacaggaagcagattctgctaataccctgcaaatagcagaaataaaagaaaagattggaactaggtcagctgaagatcctgtgagcgaagttccagcagtgtc

SEQ ID NO: 1686 - DNA, 121 bp, Homo sapiens
gacactgctggaacttcgctcacaggatcttcagctgacctagttccaatcttttcttttatttctgctatttgcagggtattagcagaatctgcttcctgtgtcgtctgattacatccta

SEQ ID NO: 1687 - DNA, 17 bp, Homo sapiens
agcagaaataaaagaaa

SEQ ID NO: 1688 - DNA, 17 bp, Homo sapiens
tttcttttatttctgct

SEQ ID NO: 1689 - DNA, 121 bp, Homo sapiens
ccaagaaacaatacagacttattgtgtagaagatactccaatatgtttttcaagatgtagttcattatcatctttgtcatcagctgaagatgaaataggatgtaatcagacgacacaggaa

SEQ ID NO: 1690 - DNA, 121 bp, Homo sapiens
ttcctgtgtcgtctgattacatcctatttcatcttcagctgatgacaaagatgataatgaactacatcttgaaaaacatattggagtatcttctacacaataagtctgtattgtttcttgg

SEQ ID NO: 1691 - DNA, 17 bp, Homo sapiens
agatgtagttcattatc

SEQ ID NO: 1692 - DNA, 17 bp, Homo sapiens
gataatgaactacatct

SEQ ID NO: 1693 - DNA, 121 bp, Homo sapiens
gattctgctaataccctgcaaatagcagaaataaaagaaaagattggaactaggtcagctgaagatcctgtgagcgaagttccagcagtgtcacagcaccctagaaccaaatccagcagac

SEQ ID NO: 1694 - DNA, 121 bp, Homo sapiens
gtctgctggatttggttctagggtgctgtgacactgctggaacttcgctcacaggatcttcagctgacctagttccaatcttttcttttatttctgctatttgcagggtattagcagaatc

SEQ ID NO: 1695 - DNA, 17 bp, Homo sapiens
ggtcagctgaagatcct

SEQ ID NO: 1696 - DNA, 17 bp, Homo sapiens
aggatcttcagctgacc

SEQ ID NO: 1697 - DNA, 121 bp, Homo sapiens
aaagaaaagattggaactaggtcagctgaagatcctgtgagcgaagttccagcagtgtcacagcaccctagaaccaaatccagcagactgcagggttctagtttatcttcagaatcagcca

SEQ ID NO: 1698 - DNA, 121 bp, Homo sapiens
tggctgattctgaagataaactagaaccctgcagtctgctggatttggttctagggtgctgtgacactgctggaacttcgctcacaggatcttcagctgacctagttccaatcttttcttt

SEQ ID NO: 1699 - DNA, 17 bp, Homo sapiens
cagtgtcacagcaccct

SEQ ID NO: 1700 - DNA, 17 bp, Homo sapiens
agggtgctgtgacactg

SEQ ID NO: 1701 - DNA, 121 bp, Homo sapiens
gatcctgtgagcgaagttccagcagtgtcacagcaccctagaaccaaatccagcagactgcagggttctagtttatcttcagaatcagccaggcacaaagctgttgaattttcttcaggag

SEQ ID NO: 1702 - DNA, 121 bp, Homo sapiens
ctcctgaagaaaattcaacagctttgtgcctggctgattctgaagataaactagaaccctgcagtctgctggatttggttctagggtgctgtgacactgctggaacttcgctcacaggatc

SEQ ID NO: 1703 - DNA, 17 bp, Homo sapiens
gcagactgcagggttct

SEQ ID NO: 1704 - DNA, 17 bp, Homo sapiens
agaaccctgcagtctgc

SEQ ID NO: 1705 - DNA, 121 bp, Homo sapiens
aagttccagcagtgtcacagcaccctagaaccaaatccagcagactgcagggttctagtttatcttcagaatcagccaggcacaaagctgttgaattttcttcaggagcgaaatctccctc

SEQ ID NO: 1706 - DNA, 121 bp, Homo sapiens
gagggagatttcgctcctgaagaaaattcaacagctttgtgcctggctgattctgaagataaactagaaccctgcagtctgctggatttggttctagggtgctgtgacactgctggaactt

SEQ ID NO: 1707 - DNA, 17 bp, Homo sapiens
ttctagtttatcttcag

SEQ ID NO: 1708 - DNA, 17 bp, Homo sapiens
ctgaagataaactagaa

SEQ ID NO: 1709 - DNA, 121 bp, Homo sapiens
cagcaccctagaaccaaatccagcagactgcagggttctagtttatcttcagaatcagccaggcacaaagctgttgaattttcttcaggagcgaaatctccctcccgaaagtggtgctcag

SEQ ID NO: 1710 - DNA, 121 bp, Homo sapiens
ctgagcaccactttcgggagggagatttcgctcctgaagaaaattcaacagctttgtgcctggctgattctgaagataaactagaaccctgcagtctgctggatttggttctagggtgctg

SEQ ID NO: 1711 - DNA, 17 bp, Homo sapiens
aatcagccaggcacaaa

SEQ ID NO: 1712 - DNA, 17 bp, Homo sapiens
tttgtgcctggctgatt

SEQ ID NO: 1713 - DNA, 121 bp, Homo sapiens
ctgcagggttctagtttatcttcagaatcagccaggcacaaagctgttgaattttcttcaggagcgaaatctccctcccgaaagtggtgctcagacaccccaaagtccacctgaacactat

SEQ ID NO: 1714 - DNA, 121 bp, Homo sapiens
atagtgttcaggtggactttggggtgtctgagcaccactttcgggagggagatttcgctcctgaagaaaattcaacagctttgtgcctggctgattctgaagataaactagaaccctgcag

SEQ ID NO: 1715 - DNA, 17 bp, Homo sapiens
tttcttcaggagcgaaa

SEQ ID NO: 1716 - DNA, 17 bp, Homo sapiens
tttcgctcctgaagaaa

SEQ ID NO: 1717 - DNA, 121 bp, Homo sapiens
ccaggcacaaagctgttgaattttcttcaggagcgaaatctccctcccgaaagtggtgctcagacaccccaaagtccacctgaacactatgttcaggagaccccactcatgtttagcagat

SEQ ID NO: 1718 - DNA, 121 bp, Homo sapiens
atctgctaaacatgagtggggtctcctgaacatagtgttcaggtggactttggggtgtctgagcaccactttcgggagggagatttcgctcctgaagaaaattcaacagctttgtgcctgg

SEQ ID NO: 1719 - DNA, 17 bp, Homo sapiens
gtggtgctcagacaccc

SEQ ID NO: 1720 - DNA, 17 bp, Homo sapiens
gggtgtctgagcaccac

SEQ ID NO: 1721 - DNA, 121 bp, Homo sapiens
aaagctgttgaattttcttcaggagcgaaatctccctccaaaagtggtgctcagacacccaaaagtccacctgaacactatgttcaggagaccccactcatgtttagcagatgtacttctg

SEQ ID NO: 1722 - DNA, 121 bp, Homo sapiens
cagaagtacatctgctaaacatgagtggggtctcctgaacatagtgttcaggtggacttttgggtgtctgagcaccacttttggagggagatttcgctcctgaagaaaattcaacagcttt

SEQ ID NO: 1723 - DNA, 17 bp, Homo sapiens
agacacccaaaagtcca

SEQ ID NO: 1724 - DNA, 17 bp, Homo sapiens
tggacttttgggtgtct

SEQ ID NO: 1725 - DNA, 121 bp, Homo sapiens
cacctgaacactatgttcaggagaccccactcatgtttagcagatgtacttctgtcagttcacttgatagttttgagagtcgttcgattgccagctccgttcagagtgaaccatgcagtgg

SEQ ID NO: 1726 - DNA, 121 bp, Homo sapiens
ccactgcatggttcactctgaacggagctggcaatcgaacgactctcaaaactatcaagtgaactgacagaagtacatctgctaaacatgagtggggtctcctgaacatagtgttcaggtg

SEQ ID NO: 1727 - DNA, 17 bp, Homo sapiens
tgtcagttcacttgata

SEQ ID NO: 1728 - DNA, 17 bp, Homo sapiens
tatcaagtgaactgaca

SEQ ID NO: 1729 - DNA, 121 bp, Homo sapiens; identical to SEQ ID NO: 1725

SEQ ID NO: 1730 - DNA, 121 bp, Homo sapiens; identical to SEQ ID NO: 1726

SEQ ID NO: 1731 - DNA, 17 bp, Homo sapiens
tgtcagttcacttgata

SEQ ID NO: 1732 - DNA, 17 bp, Homo sapiens
tatcaagtgaactgaca

SEQ ID NO: 1733 - DNA, 121 bp, Homo sapiens
gttcaggagaccccactcatgtttagcagatgtacttctgtcagttcacttgatagttttgagagtcgttcgattgccagctccgttcagagtgaaccatgcagtggaatggtaggtggca

SEQ ID NO: 1734 - DNA, 121 bp, Homo sapiens
tgccacctaccattccactgcatggttcactctgaacggagctggcaatcgaacgactctcaaaactatcaagtgaactgacagaagtacatctgctaaacatgagtggggtctcctgaac

SEQ ID NO: 1735 - DNA, 17 bp, Homo sapiens
atagttttgagagtcgt

SEQ ID NO: 1736 - DNA, 17 bp, Homo sapiens
acgactctcaaaactat

SEQ ID NO: 1737 - DNA, 121 bp, Homo sapiens
caaaccatgccaccaagcagaagtaaaacacctccaccacctcctcaaacagctcaaaccaagcgagaagtacctaaaaataaagcacctactgctgaaaagagagagagtggacctaagc

SEQ ID NO: 1738 - DNA, 121 bp, Homo sapiens
gcttaggtccactctctctcttttcagcagtaggtgctttatttttaggtacttctcgcttggtttgagctgtttgaggaggtggtggaggtgttttacttctgcttggtggcatggtttg

SEQ ID NO: 1739 - DNA, 17 bp, Homo sapiens
ctcaaaccaagcgagaa

SEQ ID NO: 1740 - DNA, 17 bp, Homo sapiens
ttctcgcttggtttgag

SEQ ID NO: 1741 - DNA, 121 bp, Homo sapiens
accatgccaccaagcagaagtaaaacacctccaccacctcctcaaacagctcaaaccaagcgagaagtacctaaaaataaagcacctactgctgaaaagagagagagtggacctaagcaag

SEQ ID NO: 1742 - DNA, 121 bp, Homo sapiens
cttgcttaggtccactctctctcttttcagcagtaggtgctttatttttaggtacttctcgcttggtttgagctgtttgaggaggtggtggaggtgttttacttctgcttggtggcatggt

SEQ ID NO: 1743 - DNA, 17 bp, Homo sapiens
aaaccaagcgagaagta

SEQ ID NO: 1744 - DNA, 17 bp, Homo sapiens
tacttctcgcttggttt

SEQ ID NO: 1745 - DNA, 121 bp, Homo sapiens
cagatgctgatactttattacattttgccacggaaagtactccagatggattttcttgttcatccagcctgagtgctctgagcctcgatgagccatttatacagaaagatgtggaattaag

SEQ ID NO: 1746 - DNA, 121 bp, Homo sapiens
cttaattccacatctttctgtataaatggctcatcgaggctcagagcactcaggctggatgaacaagaaaatccatctggagtactttccgtggcaaaatgtaataaagtatcagcatctg

SEQ ID NO: 1747 - DNA, 17 bp, Homo sapiens
ttcttgttcatccagcc

SEQ ID NO: 1748 - DNA, 17 bp, Homo sapiens
ggctggatgaacaagaa

SEQ ID NO: 1749 - DNA, 121 bp, Homo sapiens
ctgagcctcgatgagccatttatacagaaagatgtggaattaagaataatgcctccagttcaggaaaatgacaatgggaatgaaacagaatcagagcagcctaaagaatcaaatgaaaacc

SEQ ID NO: 1750 - DNA, 121 bp, Homo sapiens
ggttttcatttgattctttaggctgctctgattctgtttcattcccattgtcattttcctgaactggaggcattattcttaattccacatctttctgtataaatggctcatcgaggctcag

SEQ ID NO: 1751 - DNA, 17 bp, Homo sapiens
ctccagttcaggaaaat

SEQ ID NO: 1752 - DNA, 17 bp, Homo sapiens
attttcctgaactggag

SEQ ID NO: 1753 - DNA, 121 bp, Homo sapiens
atgtggaattaagaataatgcctccagttcaggaaaatgacaatgggaatgaaacagaatcagagcagcctaaagaatcaaatgaaaaccaagagaaagaggcagaaaaaactattgattc

SEQ ID NO: 1754 - DNA, 121 bp, Homo sapiens
gaatcaatagttttttctgcctctttctcttggttttcatttgattctttaggctgctctgattctgtttcattcccattgtcattttcctgaactggaggcattattcttaattccacat

SEQ ID NO: 1755 - DNA, 17 bp, Homo sapiens
aacagaatcagagcagc

SEQ ID NO: 1756 - DNA, 17 bp, Homo sapiens
gctgctctgattctgtt

SEQ ID NO: 1757 - DNA, 121 bp, Homo sapiens
aaaaccaagagaaagaggcagaaaaaactattgattctgaaaaggacctattagatgattcagatgatgatgatattgaaatactagaagaatgtattatttctgccatgccaacaaagtc

SEQ ID NO: 1758 - DNA, 121 bp, Homo sapiens
gactttgttggcatggcagaaataatacattcttctagtatttcaatatcatcatcatctgaatcatctaataggtccttttcagaatcaatagttttttctgcctctttctcttggtttt

SEQ ID NO: 1759 - DNA, 17 bp, Homo sapiens
agatgattcagatgatg

SEQ ID NO: 1760 - DNA, 17 bp, Homo sapiens
catcatctgaatcatct

SEQ ID NO: 1761 - DNA, 121 bp, Homo sapiens
agagagttttctcagacaacaaagattcaaagaaacagaatttgaaaaataattccaaggacttcaatgataagctcccaaataatgaagatagagtcagaggaagttttgcttttgattc

SEQ ID NO: 1762 - DNA, 121 bp, Homo sapiens
gaatcaaaagcaaaacttcctctgactctatcttcattatttgggagcttatcattgaagtccttggaattatttttcaaattctgtttctttgaatctttgttgtctgagaaaactctct

SEQ ID NO: 1763 - DNA, 17 bp, Homo sapiens
ttccaaggacttcaatg

SEQ ID NO: 1764 - DNA, 17 bp, Homo sapiens
cattgaagtccttggaa

SEQ ID NO: 1765 - DNA, 121 bp, Homo sapiens
aaaactgacagcacagaatccagtggaacccaaagtcctaagcgccattctgggtcttaccttgtgacatctgtttaaaagagaggaagaatgaaactaagaaaattctatgttaattaca

SEQ ID NO: 1766 - DNA, 121 bp, Homo sapiens
tgtaattaacatagaattttcttagtttcattcttcctctcttttaaacagatgtcacaaggtaagacccagaatggcgcttaggactttgggttccactggattctgtgctgtcagtttt

SEQ ID NO: 1767 - DNA, 17 bp, Homo sapiens
ggtcttaccttgtgaca

SEQ ID NO: 1768 - DNA, 17 bp, Homo sapiens
tgtcacaaggtaagacc

SEQ ID NO: 1769 - DNA, 121 bp, Homo sapiens
atggagaataattctggccccgagctcattcccagcagatgccagctgatgtggtcatgggcacaaactgttatatctgagaaagagggagagacacaggccaaaataagcattcagtcaa

SEQ ID NO: 1770 - DNA, 17 bp, Homo sapiens
agtttgtgcccatgacc

SEQ ID NO: 1771 - DNA, 17 bp, Homo sapiens
ggtcatgggcacaaact

SEQ ID NO: 1772 - DNA, 121 bp, Homo sapiens
tgtcctaactcagctgggatgcaggcttacattgacattaaaaactgcccaaagaaaaccaggaatcttaagaaaataactcgtgagcagaggcggcacatgaagaggtgggaatacttca

SEQ ID NO: 1773 - DNA, 121 bp, Homo sapiens
tgaagtattcccacctcttcatgtgccgcctctgctcacgagttattttcttaagattcctggttttctttgggcagtttttaatgtcaatgtaagcctgcatcccagctgagttaggaca

SEQ ID NO: 1774 - DNA, 17 bp, Homo sapiens
agaaaaccaggaatctt

SEQ ID NO: 1775 - DNA, 17 bp, Homo sapiens
aagattcctggttttct

SEQ ID NO: 1776 - DNA, 121 bp, Homo sapiens
gtcctaactcagctgggatgcaggcttacattgacattaaaaactgcccaaagaaaaccaggaatcttaagaaaataactcgtgagcagaggcggcacatgaagaggtgggaatacttcat

SEQ ID NO: 1777 - DNA, 121 bp, Homo sapiens
atgaagtattcccacctcttcatgtgccgcctctgctcacgagttattttcttaagattcctggttttctttgggcagtttttaatgtcaatgtaagcctgcatcccagctgagttaggac

SEQ ID NO: 1778 - DNA, 17 bp, Homo sapiens
gaaaaccaggaatctta

SEQ ID NO: 1779 - DNA, 17 bp, Homo sapiens
taagattcctggttttc

SEQ ID NO: 1780 - DNA, 121 bp, Homo sapiens
ccacagaaaatgatgcccagtgcttaacaagaccatactacagtgacgtggacatcatgagagacatcgcctctgggctaataggactacttctaatctgtaagagcagatccctggacag

SEQ ID NO: 1781 - DNA, 121 bp, Homo sapiens
ctgtccagggatctgctcttacagattagaagtagtcctattagcccagaggcgatgtctctcatgatgtccacgtcactgtagtatggtcttgttaagcactgggcatcattttctgtgg

SEQ ID NO: 1782 - DNA, 17 bp, Homo sapiens
catcatgagagacatcg

SEQ ID NO: 1783 - DNA, 17 bp, Homo sapiens
cgatgtctctcatgatg

SEQ ID NO: 1784 - DNA, 121 bp, Homo sapiens
acatcgcctctgggctaataggactacttctaatctgtaagagcagatccctggacaggcgaggaatacaggtattttgtccttgaagtaacctttcagaaattctgagaatttcttctgg

SEQ ID NO: 1785 - DNA, 121 bp, Homo sapiens
ccagaagaaattctcagaatttctgaaaggttacttcaaggacaaaatacctgtattcctcgcctgtccagggatctgctcttacagattagaagtagtcctattagcccagaggcgatgt

SEQ ID NO: 1786 - DNA, 17 bp, Homo sapiens
ggacaggcgaggaatac

SEQ ID NO: 1787 - DNA, 17 bp, Homo sapiens
gtattcctcgcctgtcc

SEQ ID NO: 1788 - DNA, 121 bp, Homo sapiens
gacatcgcctctgggctaataggactacttctaatctgtaagagcagatccctggacaggcgaggaatacaggtattttgtccttgaagtaacctttcagaaattctgagaatttcttctg

SEQ ID NO: 1789 - DNA, 121 bp, Homo sapiens
cagaagaaattctcagaatttctgaaaggttacttcaaggacaaaatacctgtattcctcgcctgtccagggatctgctcttacagattagaagtagtcctattagcccagaggcgatgtc

SEQ ID NO: 1790 - DNA, 17 bp, Homo sapiens
tggacaggcgaggaata

SEQ ID NO: 1791 - DNA, 17 bp, Homo sapiens
tattcctcgcctgtcca

SEQ ID NO: 1792 - DNA, 121 bp, Homo sapiens
agtgatgctgactatgattaccagaacagactggctgcagcattaggaatcaggtcattccgaaactcatcattgaatcaggaagaagaagagttcaatcttactgccctagctctggaga

SEQ ID NO: 1793 - DNA, 121 bp, Homo sapiens
tctccagagctagggcagtaagattgaactcttcttcttcctgattcaatgatgagtttcggaatgacctgattcctaatgctgcagccagtctgttctggtaatcatagtcagcatcact

SEQ ID NO: 1794 - DNA, 17 bp, Homo sapiens
ggtcattccgaaactca

SEQ ID NO: 1795 - DNA, 17 bp, Homo sapiens
tgagtttcggaatgacc

SEQ ID NO: 1796 - DNA, 121 bp, Homo sapiens
tcagtcagacaaacctttccccagccctcggtcagatgcccatttctccagacctcagccatacaaccctttctctagacttcagccagacaaacctctctccagaactcagtcaaacaaa

SEQ ID NO: 1797 - DNA, 121 bp, Homo sapiens
tttgtttgactgagttctggagagaggtttgtctggctgaagtctagagaaagggttgtatggctgaggtctggagaaatgggcatctgaccgagggctggggaaaggtttgtctgactga

SEQ ID NO: 1798 - DNA, 17 bp, Homo sapiens
cctcagccatacaaccc

SEQ ID NO: 1799 - DNA, 17 bp, Homo sapiens
gggttgtatggctgagg

SEQ ID NO: 1800 - DNA, 121 bp, Homo sapiens
agctctccacctgcttctttctgtgccttttgcgattctgctttagtgccaccagaagatactacctgggtgcagtggaactgtcatgggactatatgcaaagtgatctcggtgagctgcc

SEQ ID NO: 1801 - DNA, 121 bp, Homo sapiens
ggcagctcaccgagatcactttgcatatagtcccatgacagttccactgcacccaggtagtatcttctggtggcactaaagcagaatcgcaaaaggcacagaaagaagcaggtggagagct

SEQ ID NO: 1802 - DNA, 17 bp, Homo sapiens
cagaagatactacctgg

SEQ ID NO: 1803 - DNA, 17 bp, Homo sapiens
ccaggtagtatcttctg

SEQ ID NO: 1804 - DNA, 121 bp, Homo sapiens
ccacctgcttctttctgtgccttttgcgattctgctttagtgccaccagaagatactacctgggtgcagtggaactgtcatgggactatatgcaaagtgatctcggtgagctgcctgtgga

SEQ ID NO: 1805 - DNA, 121 bp, Homo sapiens
tccacaggcagctcaccgagatcactttgcatatagtcccatgacagttccactgcacccaggtagtatcttctggtggcactaaagcagaatcgcaaaaggcacagaaagaagcaggtgg

SEQ ID NO: 1806 - DNA, 17 bp, Homo sapiens
atactacctgggtgcag

SEQ ID NO: 1807 - DNA, 17 bp, Homo sapiens
ctgcacccaggtagtat

SEQ ID NO: 1808 - DNA, 121 bp, Homo sapiens
agtcatgcaaatagagctctccacctgcttctttctgtgccttttgcgattctgctttagtgccaccagaagatactacctgggtgcagtggaactgtcatgggactatatgcaaagtgat

SEQ ID NO: 1809 - DNA, 121 bp, Homo sapiens
atcactttgcatatagtcccatgacagttccactgcacccaggtagtatcttctggtggcactaaagcagaatcgcaaaaggcacagaaagaagcaggtggagagctctatttgcatgact

SEQ ID NO: 1810 - DNA, 17 bp, Homo sapiens
tgctttagtgccaccag

SEQ ID NO: 1811 - DNA, 17 bp, Homo sapiens
ctggtggcactaaagca

SEQ ID NO: 1812 - DNA, 121 bp, Homo sapiens
catttgtagcaataagtcatgcaaatagagctctccacctgcttctttctgtgccttttgcgattctgctttagtgccaccagaagatactacctgggtgcagtggaactgtcatgggact

SEQ ID NO: 1813 - DNA, 121 bp, Homo sapiens
agtcccatgacagttccactgcacccaggtagtatcttctggtggcactaaagcagaatcgcaaaaggcacagaaagaagcaggtggagagctctatttgcatgacttattgctacaaatg

SEQ ID NO: 1814 - DNA, 17 bp, Homo sapiens
gccttttgcgattctgc

SEQ ID NO: 1815 - DNA, 17 bp, Homo sapiens
gcagaatcgcaaaaggc

SEQ ID NO: 1816 - DNA, 121 bp, Homo sapiens
ttctgtgccttttgcgattctgctttagtgccaccagaagatactacctgggtgcagtggaactgtcatgggactatatgcaaagtgatctcggtgagctgcctgtggacgcaaggtaaag

SEQ ID NO: 1817 - DNA, 121 bp, Homo sapiens
ctttaccttgcgtccacaggcagctcaccgagatcactttgcatatagtcccatgacagttccactgcacccaggtagtatcttctggtggcactaaagcagaatcgcaaaaggcacagaa

SEQ ID NO: 1818 - DNA, 17 bp, Homo sapiens
tgcagtggaactgtcat

SEQ ID NO: 1819 - DNA, 17 bp, Homo sapiens
atgacagttccactgca

SEQ ID NO: 1820 - DNA, 121 bp, Homo sapiens
cttttgcgattctgctttagtgccaccagaagatactacctgggtgcagtggaactgtcatgggactatatgcaaagtgatctcggtgagctgcctgtggacgcaaggtaaaggcatgtcc

SEQ ID NO: 1821 - DNA, 121 bp, Homo sapiens
ggacatgcctttaccttgcgtccacaggcagctcaccgagatcactttgcatatagtcccatgacagttccactgcacccaggtagtatcttctggtggcactaaagcagaatcgcaaaag

SEQ ID NO: 1822 - DNA, 17 bp, Homo sapiens
aactgtcatgggactat

SEQ ID NO: 1823 - DNA, 17 bp, Homo sapiens
atagtcccatgacagtt

SEQ ID NO: 1824 - DNA, 121 bp, Homo sapiens
ttcacgcagatttcctcctagagtgccaaaatcttttccattcaacacctcagtcgtgtacaaaaagactctgtttgtagaattcacggatcaccttttcaacatcgctaagccaaggcca

SEQ ID NO: 1825 - DNA, 121 bp, Homo sapiens
tggccttggcttagcgatgttgaaaaggtgatccgtgaattctacaaacagagtctttttgtacacgactgaggtgttgaatggaaaagattttggcactctaggaggaaatctgcgtgaa

SEQ ID NO: 1826 - DNA, 17 bp, Homo sapiens
gtcgtgtacaaaaagac

SEQ ID NO: 1827 - DNA, 17 bp, Homo sapiens
gtctttttgtacacgac

SEQ ID NO: 1828 - DNA, 121 bp, Homo sapiens
atcttttccattcaacacctcagtcgtgtacaaaaagactctgtttgtagaattcacggatcaccttttcaacatcgctaagccaaggccaccctggatgggtaatgaaaacaatgttgaa

SEQ ID NO: 1829 - DNA, 121 bp, Homo sapiens
ttcaacattgttttcattacccatccagggtggccttggcttagcgatgttgaaaaggtgatccgtgaattctacaaacagagtctttttgtacacgactgaggtgttgaatggaaaagat

SEQ ID NO: 1830 - DNA, 17 bp, Homo sapiens
ttcacggatcacctttt

SEQ ID NO: 1831 - DNA, 17 bp, Homo sapiens
aaaaggtgatccgtgaa

SEQ ID NO: 1832 - DNA, 121 bp, Homo sapiens
ttctggagtactatccccaagtaacctttggcggacatctcattcttacaggtctgctaggtcctaccatccaggctgaggtttatgatacagtggtcattacacttaagaacatggcttc

SEQ ID NO: 1833 - DNA, 121 bp, Homo sapiens
gaagccatgttcttaagtgtaatgaccactgtatcataaacctcagcctggatggtaggacctagcagacctgtaagaatgagatgtccgccaaaggttacttggggatagtactccagaa

SEQ ID NO: 1834 - DNA, 17 bp, Homo sapiens
tctgctaggtcctacca

SEQ ID NO: 1835 - DNA, 17 bp, Homo sapiens
tggtaggacctagcaga

SEQ ID NO: 1836 - DNA, 121 bp, Homo sapiens
caagtaacctttggcggacatctcattcttacaggtctgctaggtcctaccatccaggctgaggtttatgatacagtggtcattacacttaagaacatggcttcccatcctgtcagtcttc

SEQ ID NO: 1837 - DNA, 121 bp, Homo sapiens
gaagactgacaggatgggaagccatgttcttaagtgtaatgaccactgtatcataaacctcagcctggatggtaggacctagcagacctgtaagaatgagatgtccgccaaaggttacttg

SEQ ID NO: 1838 - DNA, 17 bp, Homo sapiens
tccaggctgaggtttat

SEQ ID NO: 1839 - DNA, 17 bp, Homo sapiens
ataaacctcagcctgga

SEQ ID NO: 1840 - DNA, 121 bp, Homo sapiens
taacctttggcggacatctcattcttacaggtctgctaggtcctaccatccaggctgaggtttatgatacagtggtcattacacttaagaacatggcttcccatcctgtcagtcttcatgc

SEQ ID NO: 1841 - DNA, 121 bp, Homo sapiens
gcatgaagactgacaggatgggaagccatgttcttaagtgtaatgaccactgtatcataaacctcagcctggatggtaggacctagcagacctgtaagaatgagatgtccgccaaaggtta

SEQ ID NO: 1842 - DNA, 17 bp, Homo sapiens
ggctgaggtttatgata

SEQ ID NO: 1843 - DNA, 17 bp, Homo sapiens
tatcataaacctcagcc

SEQ ID NO: 1844 - DNA, 121 bp, Homo sapiens
ttggcggacatctcattcttacaggtctgctaggtcctaccatccaggctgaggtttatgatacagtggtcattacacttaagaacatggcttcccatcctgtcagtcttcatgctgttgg

SEQ ID NO: 1845 - DNA, 121 bp, Homo sapiens
ccaacagcatgaagactgacaggatgggaagccatgttcttaagtgtaatgaccactgtatcataaacctcagcctggatggtaggacctagcagacctgtaagaatgagatgtccgccaa

SEQ ID NO: 1846 - DNA, 17 bp, Homo sapiens
ggtttatgatacagtgg

SEQ ID NO: 1847 - DNA, 17 bp, Homo sapiens
ccactgtatcataaacc

SEQ ID NO: 1848 - DNA, 121 bp, Homo sapiens; identical to SEQ ID NO: 1844

SEQ ID NO: 1849 - DNA, 121 bp, Homo sapiens; identical to SEQ ID NO: 1845

SEQ ID NO: 1850 - DNA, 17 bp, Homo sapiens
ggtttatgatacagtgg

SEQ ID NO: 1851 - DNA, 17 bp, Homo sapiens
ccactgtatcataaacc

SEQ ID NO: 1852 - DNA, 121 bp, Homo sapiens
atctcattcttacaggtctgctaggtcctaccatccaggctgaggtttatgatacagtggtcattacacttaagaacatggcttcccatcctgtcagtcttcatgctgttggtgtatccta

SEQ ID NO: 1853 - DNA, 121 bp, Homo sapiens
taggatacaccaacagcatgaagactgacaggatgggaagccatgttcttaagtgtaatgaccactgtatcataaacctcagcctggatggtaggacctagcagacctgtaagaatgagat

SEQ ID NO: 1854 - DNA, 17 bp, Homo sapiens
tacagtggtcattacac

SEQ ID NO: 1855 - DNA, 17 bp, Homo sapiens
gtgtaatgaccactgta

SEQ ID NO: 1856 - DNA, 121 bp, Homo sapiens
caggtctgctaggtcctaccatccaggctgaggtttatgatacagtggtcattacacttaagaacatggcttcccatcctgtcagtcttcatgctgttggtgtatcctactggaaagcttc

SEQ ID NO: 1857 - DNA, 121 bp, Homo sapiens
gaagctttccagtaggatacaccaacagcatgaagactgacaggatgggaagccatgttcttaagtgtaatgaccactgtatcataaacctcagcctggatggtaggacctagcagacctg

SEQ ID NO: 1858 - DNA, 17 bp, Homo sapiens
tacacttaagaacatgg

SEQ ID NO: 1859 - DNA, 17 bp, Homo sapiens
ccatgttcttaagtgta

SEQ ID NO: 1860 - DNA, 121 bp, Homo sapiens
ctgctaggtcctaccatccaggctgaggtttatgatacagtggtcattacacttaagaacatggcttcccatcctgtcagtcttcatgctgttggtgtatcctactggaaagcttctgagg

SEQ ID NO: 1861 - DNA, 121 bp, Homo sapiens
cctcagaagctttccagtaggatacaccaacagcatgaagactgacaggatgggaagccatgttcttaagtgtaatgaccactgtatcataaacctcagcctggatggtaggacctagcag

SEQ ID NO: 1862 - DNA, 17 bp, Homo sapiens
ttaagaacatggcttcc

SEQ ID NO: 1863 - DNA, 17 bp, Homo sapiens
ggaagccatgttcttaa

SEQ ID NO: 1864 - DNA, 121 bp, Homo sapiens
ctaccatccaggctgaggtttatgatacagtggtcattacacttaagaacatggcttcccatcctgtcagtcttcatgctgttggtgtatcctactggaaagcttctgagggtgagtaaaa

SEQ ID NO: 1865 - DNA, 121 bp, Homo sapiens
ttttactcaccctcagaagctttccagtaggatacaccaacagcatgaagactgacaggatgggaagccatgttcttaagtgtaatgaccactgtatcataaacctcagcctggatggtag

SEQ ID NO: 1866 - DNA, 17 bp, Homo sapiens
ggcttcccatcctgtca

SEQ ID NO: 1867 - DNA, 17 bp, Homo sapiens
tgacaggatgggaagcc

SEQ ID NO: 1868 - DNA, 121 bp, Homo sapiens
cctaccatccaggctgaggtttatgatacagtggtcattacacttaagaacatggcttcccatcctgtcagtcttcatgctgttggtgtatcctactggaaagcttctgagggtgagtaaa

SEQ ID NO: 1869 - DNA, 121 bp, Homo sapiens
tttactcaccctcagaagctttccagtaggatacaccaacagcatgaagactgacaggatgggaagccatgttcttaagtgtaatgaccactgtatcataaacctcagcctggatggtagg

SEQ ID NO: 1870 - DNA, 17 bp, Homo sapiens
tggcttcccatcctgtc

SEQ ID NO: 1871 - DNA, 17 bp, Homo sapiens
gacaggatgggaagcca

SEQ ID NO: 1872 - DNA, 121 bp, Homo sapiens
ctgaggtttatgatacagtggtcattacacttaagaacatggcttcccatcctgtcagtcttcatgctgttggtgtatcctactggaaagcttctgagggtgagtaaaataccctcctatt

SEQ ID NO: 1873 - DNA, 121 bp, Homo sapiens
aataggagggtattttactcaccctcagaagctttccagtaggatacaccaacagcatgaagactgacaggatgggaagccatgttcttaagtgtaatgaccactgtatcataaacctcag

SEQ ID NO: 1874 - DNA, 17 bp, Homo sapiens
tgtcagtcttcatgctg

SEQ ID NO: 1875 - DNA, 17 bp, Homo sapiens
cagcatgaagactgaca

SEQ ID NO: 1876 - DNA, 121 bp, Homo sapiens
gatacagtggtcattacacttaagaacatggcttcccatcctgtcagtcttcatgctgttggtgtatcctactggaaagcttctgagggtgagtaaaataccctcctattgtcctgtcatt

SEQ ID NO: 1877 - DNA, 121 bp, Homo sapiens
aatgacaggacaataggagggtattttactcaccctcagaagctttccagtaggatacaccaacagcatgaagactgacaggatgggaagccatgttcttaagtgtaatgaccactgtatc

SEQ ID NO: 1878 - DNA, 17 bp, Homo sapiens
atgctgttggtgtatcc

SEQ ID NO: 1879 - DNA, 17 bp, Homo sapiens
ggatacaccaacagcat

SEQ ID NO: 1880 - DNA, 121 bp, Homo sapiens
ctttgagtgtacagtggatatagaaaggacaattttatttcttcctgctataggagctgaatatgatgatcagaccagtcaaagggagaaagaagatgataaagtcttccctggtggaagc

SEQ ID NO: 1881 - DNA, 121 bp, Homo sapiens
gcttccaccagggaagactttatcatcttctttctccctttgactggtctgatcatcatattcagctcctatagcaggaagaaataaaattgtcctttctatatccactgtacactcaaag

SEQ ID NO: 1882 - DNA, 17 bp, Homo sapiens
ggagctgaatatgatga

SEQ ID NO: 1883 - DNA, 17 bp, Homo sapiens
tcatcatattcagctcc

SEQ ID NO: 1884 - DNA, 121 bp, Homo sapiens
ttgagtgtacagtggatatagaaaggacaattttatttcttcctgctataggagctgaatatgatgatcagaccagtcaaagggagaaagaagatgataaagtcttccctggtggaagcca

SEQ ID NO: 1885 - DNA, 121 bp, Homo sapiens
tggcttccaccagggaagactttatcatcttctttctccctttgactggtctgatcatcatattcagctcctatagcaggaagaaataaaattgtcctttctatatccactgtacactcaa

SEQ ID NO: 1886 - DNA, 17 bp, Homo sapiens
agctgaatatgatgatc

SEQ ID NO: 1887 - DNA, 17 bp, Homo sapiens
gatcatcatattcagct

SEQ ID NO: 1888 - DNA, 121 bp, Homo sapiens
gtacagtggatatagaaaggacaattttatttcttcctgctataggagctgaatatgatgatcagaccagtcaaagggagaaagaagatgataaagtcttccctggtggaagccatacata

SEQ ID NO: 1889 - DNA, 121 bp, Homo sapiens
tatgtatggcttccaccagggaagactttatcatcttctttctccctttgactggtctgatcatcatattcagctcctatagcaggaagaaataaaattgtcctttctatatccactgtac

SEQ ID NO: 1890 - DNA, 17 bp, Homo sapiens
atatgatgatcagacca

SEQ ID NO: 1891 - DNA, 17 bp, Homo sapiens
tggtctgatcatcatat

SEQ ID NO: 1892 - DNA, 121 bp, Homo sapiens
acagtggatatagaaaggacaattttatttcttcctgctataggagctgaatatgatgatcagaccagtcaaagggagaaagaagatgataaagtcttccctggtggaagccatacatatg

SEQ ID NO: 1893 - DNA, 121 bp, Homo sapiens
catatgtatggcttccaccagggaagactttatcatcttctttctccctttgactggtctgatcatcatattcagctcctatagcaggaagaaataaaattgtcctttctatatccactgt

SEQ ID NO: 1894 - DNA, 17 bp, Homo sapiens
atgatgatcagaccagt

SEQ ID NO: 1895 - DNA, 17 bp, Homo sapiens
actggtctgatcatcat

SEQ ID NO: 1896 - DNA, 121 bp, Homo sapiens
tggatatagaaaggacaattttatttcttcctgctataggagctgaatatgatgatcagaccagtcaaagggagaaagaagatgataaagtcttccctggtggaagccatacatatgtctg

SEQ ID NO: 1897 - DNA, 121 bp, Homo sapiens
cagacatatgtatggcttccaccagggaagactttatcatcttctttctccctttgactggtctgatcatcatattcagctcctatagcaggaagaaataaaattgtcctttctatatcca

SEQ ID NO: 1898 - DNA, 17 bp, Homo sapiens
tgatcagaccagtcaaa

SEQ ID NO: 1899 - DNA, 17 bp, Homo sapiens
tttgactggtctgatca

SEQ ID NO: 1900 - DNA, 121 bp, Homo sapiens
aggacaattttatttcttcctgctataggagctgaatatgatgatcagaccagtcaaagggagaaagaagatgataaagtcttccctggtggaagccatacatatgtctggcaggtcctga

SEQ ID NO: 1901 - DNA, 121 bp, Homo sapiens
tcaggacctgccagacatatgtatggcttccaccagggaagactttatcatcttctttctccctttgactggtctgatcatcatattcagctcctatagcaggaagaaataaaattgtcct

SEQ ID NO: 1902 - DNA, 17 bp, Homo sapiens
gtcaaagggagaaagaa

SEQ ID NO: 1903 - DNA, 17 bp, Homo sapiens
ttctttctccctttgac

SEQ ID NO: 1904 - DNA, 121 bp, Homo sapiens
tttcttcctgctataggagctgaatatgatgatcagaccagtcaaagggagaaagaagatgataaagtcttccctggtggaagccatacatatgtctggcaggtcctgaaagagaatggtc

SEQ ID NO: 1905 - DNA, 121 bp, Homo sapiens
gaccattctctttcaggacctgccagacatatgtatggcttccaccagggaagactttatcatcttctttctccctttgactggtctgatcatcatattcagctcctatagcaggaagaaa

SEQ ID NO: 1906 - DNA, 17 bp, Homo sapiens
aagaagatgataaagtc

SEQ ID NO: 1907 - DNA, 17 bp, Homo sapiens
gactttatcatcttctt

SEQ ID NO: 1908 - DNA, 121 bp, Homo sapiens
agtcaaagggagaaagaagatgataaagtcttccctggtggaagccatacatatgtctggcaggtcctgaaagagaatggtccaatggcctctgacccactgtgccttacctactcatatc

SEQ ID NO: 1909 - DNA, 121 bp, Homo sapiens
gatatgagtaggtaaggcacagtgggtcagaggccattggaccattctctttcaggacctgccagacatatgtatggcttccaccagggaagactttatcatcttctttctccctttgact

SEQ ID NO: 1910 - DNA, 17 bp, Homo sapiens
atgtctggcaggtcctg

SEQ ID NO: 1911 - DNA, 17 bp, Homo sapiens
caggacctgccagacat

SEQ ID NO: 1912 - DNA, 121 bp, Homo sapiens
aaagggagaaagaagatgataaagtcttccctggtggaagccatacatatgtctggcaggtcctgaaagagaatggtccaatggcctctgacccactgtgccttacctactcatatctttc

SEQ ID NO: 1913 - DNA, 121 bp, Homo sapiens
gaaagatatgagtaggtaaggcacagtgggtcagaggccattggaccattctctttcaggacctgccagacatatgtatggcttccaccagggaagactttatcatcttctttctcccttt

SEQ ID NO: 1914 - DNA, 17 bp, Homo sapiens
ctggcaggtcctgaaag

SEQ ID NO: 1915 - DNA, 17 bp, Homo sapiens
ctttcaggacctgccag

SEQ ID NO: 1916 - DNA, 121 bp, Homo sapiens
agatgataaagtcttccctggtggaagccatacatatgtctggcaggtcctgaaagagaatggtccaatggcctctgacccactgtgccttacctactcatatctttctcatgtggacctg

SEQ ID NO: 1917 - DNA, 121 bp, Homo sapiens
caggtccacatgagaaagatatgagtaggtaaggcacagtgggtcagaggccattggaccattctctttcaggacctgccagacatatgtatggcttccaccagggaagactttatcatct

SEQ ID NO: 1918 - DNA, 17 bp, Homo sapiens
aaagagaatggtccaat

SEQ ID NO: 1919 - DNA, 17 bp, Homo sapiens
attggaccattctcttt

SEQ ID NO: 1920 - DNA, 121 bp, Homo sapiens
atgataaagtcttccctggtggaagccatacatatgtctggcaggtcctgaaagagaatggtccaatggcctctgacccactgtgccttacctactcatatctttctcatgtggacctggt

SEQ ID NO: 1921 - DNA, 121 bp, Homo sapiens
accaggtccacatgagaaagatatgagtaggtaaggcacagtgggtcagaggccattggaccattctctttcaggacctgccagacatatgtatggcttccaccagggaagactttatcat

SEQ ID NO: 1922 - DNA, 17 bp, Homo sapiens
agagaatggtccaatgg

SEQ ID NO: 1923 - DNA, 17 bp, Homo sapiens
ccattggaccattctct

SEQ ID NO: 1924 - DNA, 121 bp, Homo sapiens; identical to SEQ ID NO: 1920

SEQ ID NO: 1925 - DNA, 121 bp, Homo sapiens; identical to SEQ ID NO: 1921

SEQ ID NO: 1926 - DNA, 17 bp, Homo sapiens
agagaatggtccaatgg

SEQ ID NO: 1927 - DNA, 17 bp, Homo sapiens
ccattggaccattctct

SEQ ID NO: 1928 - DNA, 121 bp, Homo sapiens
gataaagtcttccctggtggaagccatacatatgtctggcaggtcctgaaagagaatggtccaatggcctctgacccactgtgccttacctactcatatctttctcatgtggacctggtaa

SEQ ID NO: 1929 - DNA, 121 bp, Homo sapiens
ttaccaggtccacatgagaaagatatgagtaggtaaggcacagtgggtcagaggccattggaccattctctttcaggacctgccagacatatgtatggcttccaccagggaagactttatc

SEQ ID NO: 1930 - DNA, 17 bp, Homo sapiens
agaatggtccaatggcc

SEQ ID NO: 1931 - DNA, 17 bp, Homo sapiens
ggccattggaccattct

SEQ ID NO: 1932 - DNA, 121 bp, Homo sapiens
ccatacatatgtctggcaggtcctgaaagagaatggtccaatggcctctgacccactgtgccttacctactcatatctttctcatgtggacctggtaaaagacttgaattcaggcctcatt

SEQ ID NO: 1933 - DNA, 121 bp, Homo sapiens
aatgaggcctgaattcaagtcttttaccaggtccacatgagaaagatatgagtaggtaaggcacagtgggtcagaggccattggaccattctctttcaggacctgccagacatatgtatgg

SEQ ID NO: 1934 - DNA, 17 bp, Homo sapiens
ccactgtgccttaccta

SEQ ID NO: 1935 - DNA, 17 bp, Homo sapiens
taggtaaggcacagtgg

SEQ ID NO: 1936 - DNA, 121 bp, Homo sapiens
tgtctggcaggtcctgaaagagaatggtccaatggcctctgacccactgtgccttacctactcatatctttctcatgtggacctggtaaaagacttgaattcaggcctcattggagcccta

SEQ ID NO: 1937 - DNA, 121 bp, Homo sapiens
tagggctccaatgaggcctgaattcaagtcttttaccaggtccacatgagaaagatatgagtaggtaaggcacagtgggtcagaggccattggaccattctctttcaggacctgccagaca

SEQ ID NO: 1938 - DNA, 17 bp, Homo sapiens
cttacctactcatatct

SEQ ID NO: 1939 - DNA, 17 bp, Homo sapiens
agatatgagtaggtaag

SEQ ID NO: 1940 - DNA, 121 bp, Homo sapiens
gtctggcaggtcctgaaagagaatggtccaatggcctctgacccactgtgccttacctactcatatctttctcatgtggacctggtaaaagacttgaattcaggcctcattggagccctac

SEQ ID NO: 1941 - DNA, 121 bp, Homo sapiens
gtagggctccaatgaggcctgaattcaagtcttttaccaggtccacatgagaaagatatgagtaggtaaggcacagtgggtcagaggccattggaccattctctttcaggacctgccagac

SEQ ID NO: 1942 - DNA, 17 bp, Homo sapiens
ttacctactcatatctt

SEQ ID NO: 1943 - DNA, 17 bp, Homo sapiens
aagatatgagtaggtaa

SEQ ID NO: 1944 - DNA, 121 bp, Homo sapiens
gtcctgaaagagaatggtccaatggcctctgacccactgtgccttacctactcatatctttctcatgtggacctggtaaaagacttgaattcaggcctcattggagccctactagtatgta

SEQ ID NO: 1945 - DNA, 121 bp, Homo sapiens
tacatactagtagggctccaatgaggcctgaattcaagtcttttaccaggtccacatgagaaagatatgagtaggtaaggcacagtgggtcagaggccattggaccattctctttcaggac

SEQ ID NO: 1946 - DNA, 17 bp, Homo sapiens
catatctttctcatgtg

SEQ ID NO: 1947 - DNA, 17 bp, Homo sapiens
cacatgagaaagatatg

SEQ ID NO: 1948 - DNA, 121 bp, Homo sapiens
aaagagaatggtccaatggcctctgacccactgtgccttacctactcatatctttctcatgtggacctggtaaaagacttgaattcaggcctcattggagccctactagtatgtagagaag

SEQ ID NO: 1949 - DNA, 121 bp, Homo sapiens
cttctctacatactagtagggctccaatgaggcctgaattcaagtcttttaccaggtccacatgagaaagatatgagtaggtaaggcacagtgggtcagaggccattggaccattctcttt

SEQ ID NO: 1950 - DNA, 17 bp, Homo sapiens
tttctcatgtggacctg

SEQ ID NO: 1951 - DNA, 17 bp, Homo sapiens
caggtccacatgagaaa

SEQ ID NO: 1952 - DNA, 121 bp, Homo sapiens
caatggcctctgacccactgtgccttacctactcatatctttctcatgtggacctggtaaaagacttgaattcaggcctcattggagccctactagtatgtagagaaggtaagtgtatgaa

SEQ ID NO: 1953 - DNA, 121 bp, Homo sapiens
ttcatacacttaccttctctacatactagtagggctccaatgaggcctgaattcaagtcttttaccaggtccacatgagaaagatatgagtaggtaaggcacagtgggtcagaggccattg

SEQ ID NO: 1954 - DNA, 17 bp, Homo sapiens
cctggtaaaagacttga

SEQ ID NO: 1955 - DNA, 17 bp, Homo sapiens
tcaagtcttttaccagg

SEQ ID NO: 1956 - DNA, 121 bp, Homo sapiens
acccactgtgccttacctactcatatctttctcatgtggacctggtaaaagacttgaattcaggcctcattggagccctactagtatgtagagaaggtaagtgtatgaaagcgtaggattg

SEQ ID NO: 1957 - DNA, 121 bp, Homo sapiens
caatcctacgctttcatacacttaccttctctacatactagtagggctccaatgaggcctgaattcaagtcttttaccaggtccacatgagaaagatatgagtaggtaaggcacagtgggt

SEQ ID NO: 1958 - DNA, 17 bp, Homo sapiens
cttgaattcaggcctca

SEQ ID NO: 1959 - DNA, 17 bp, Homo sapiens
tgaggcctgaattcaag

SEQ ID NO: 1960 - DNA, 121 bp, Homo sapiens
aatgttctcacttctttttcagggagtctggccaaggaaaagacacagaccttgcacaaatttatactactttttgctgtatttgatgaaggttagtgagtcttaatctgaattttggatt

SEQ ID NO: 1961 - DNA, 121 bp, Homo sapiens
aatccaaaattcagattaagactcactaaccttcatcaaatacagcaaaaagtagtataaatttgtgcaaggtctgtgtcttttccttggccagactccctgaaaaagaagtgagaacatt

SEQ ID NO: 1962 - DNA, 17 bp, Homo sapiens
tgcacaaatttatacta

SEQ ID NO: 1963 - DNA, 17 bp, Homo sapiens
tagtataaatttgtgca

SEQ ID NO: 1964 - DNA, 121 bp, Homo sapiens
cttctttttcagggagtctggccaaggaaaagacacagaccttgcacaaatttatactactttttgctgtatttgatgaaggttagtgagtcttaatctgaattttggattcctgaaagaa

SEQ ID NO: 1965 - DNA, 121 bp, Homo sapiens
ttctttcaggaatccaaaattcagattaagactcactaaccttcatcaaatacagcaaaaagtagtataaatttgtgcaaggtctgtgtcttttccttggccagactccctgaaaaagaag

SEQ ID NO: 1966 - DNA, 17 bp, Homo sapiens
tatactactttttgctg

SEQ ID NO: 1967 - DNA, 17 bp, Homo sapiens
cagcaaaaagtagtata

SEQ ID NO: 1968 - DNA, 121 bp, Homo sapiens
tttcagggagtctggccaaggaaaagacacagaccttgcacaaatttatactactttttgctgtatttgatgaaggttagtgagtcttaatctgaattttggattcctgaaagaaatcctc

SEQ ID NO: 1969 - DNA, 121 bp, Homo sapiens
gaggatttctttcaggaatccaaaattcagattaagactcactaaccttcatcaaatacagcaaaaagtagtataaatttgtgcaaggtctgtgtcttttccttggccagactccctgaaa

SEQ ID NO: 1970 - DNA, 17 bp, Homo sapiens
actttttgctgtatttg

SEQ ID NO: 1971 - DNA, 17 bp, Homo sapiens
caaatacagcaaaaagt

SEQ ID NO: 1972 - DNA, 121 bp, Homo sapiens
ttttcagggagtctggccaaggaaaagacacagaccttgcacaaatttatactactttttgctgtatttgatgaaggttagtgagtcttaatctgaattttggattcctgaaagaaatcct

SEQ ID NO: 1973 - DNA, 121 bp, Homo sapiens
aggatttctttcaggaatccaaaattcagattaagactcactaaccttcatcaaatacagcaaaaagtagtataaatttgtgcaaggtctgtgtcttttccttggccagactccctgaaaa

SEQ ID NO: 1974 - DNA, 17 bp, Homo sapiens
tactttttgctgtattt

SEQ ID NO: 1975 - DNA, 17 bp, Homo sapiens
aaatacagcaaaaagta

SEQ ID NO: 1976 - DNA, 121 bp, Homo sapiens
aactccttgatgcaggatagggatgctgcatctgctcgggcctggcctaaaatgcacacagtcaatggttatgtaaacaggtctctgccaggtatgtacacacctgctcaacaatcctcag

SEQ ID NO: 1977 - DNA, 121 bp, Homo sapiens
ctgaggattgttgagcaggtgtgtacatacctggcagagacctgtttacataaccattgactgtgtgcattttaggccaggcccgagcagatgcagcatccctatcctgcatcaaggagtt

SEQ ID NO: 1978 - DNA, 17 bp, Homo sapiens
tgcacacagtcaatggt

SEQ ID NO: 1979 - DNA, 17 bp, Homo sapiens
accattgactgtgtgca

SEQ ID NO: 1980 - DNA, 121 bp, Homo sapiens
atttcagattctctacttcatagccataggtgtcttattcctactttacaggtctgattggatgccacaggaaatcagtctattggcatgtgattggaatgggcaccactcctgaagtgca

SEQ ID NO: 1981 - DNA, 121 bp, Homo sapiens
tgcacttcaggagtggtgcccattccaatcacatgccaatagactgatttcctgtggcatccaatcagacctgtaaagtaggaataagacacctatggctatgaagtagagaatctgaaat

SEQ ID NO: 1982 - DNA, 17 bp, Homo sapiens
tctgattggatgccaca

SEQ ID NO: 1983 - DNA, 17 bp, Homo sapiens
tgtggcatccaatcaga

SEQ ID NO: 1984 - DNA, 121 bp, Homo sapiens
ataggtgtcttattcctactttacaggtctgattggatgccacaggaaatcagtctattggcatgtgattggaatgggcaccactcctgaagtgcactcaatattcctcgaaggtcacaca

SEQ ID NO: 1985 - DNA, 121 bp, Homo sapiens
tgtgtgaccttcgaggaatattgagtgcacttcaggagtggtgcccattccaatcacatgccaatagactgatttcctgtggcatccaatcagacctgtaaagtaggaataagacacctat

SEQ ID NO: 1986 - DNA, 17 bp, Homo sapiens
gtctattggcatgtgat

SEQ ID NO: 1987 - DNA, 17 bp, Homo sapiens
atcacatgccaatagac

SEQ ID NO: 1988 - DNA, 121 bp, Homo sapiens; identical to SEQ ID NO: 1984

SEQ ID NO: 1989 - DNA, 121 bp, Homo sapiens; identical to SEQ ID NO: 1985

SEQ ID NO: 1990 - DNA, 17 bp, Homo sapiens
gtctattggcatgtgat

SEQ ID NO: 1991 - DNA, 17 bp, Homo sapiens
atcacatgccaatagac

SEQ ID NO: 1992 - DNA, 121 bp, Homo sapiens
aggtgtcttattcctactttacaggtctgattggatgccacaggaaatcagtctattggcatgtgattggaatgggcaccactcctgaagtgcactcaatattcctcgaaggtcacacatt

SEQ ID NO: 1993 - DNA, 121 bp, Homo sapiens
aatgtgtgaccttcgaggaatattgagtgcacttcaggagtggtgcccattccaatcacatgccaatagactgatttcctgtggcatccaatcagacctgtaaagtaggaataagacacct

SEQ ID NO: 1994 - DNA, 17 bp, Homo sapiens
ctattggcatgtgattg

SEQ ID NO: 1995 - DNA, 17 bp, Homo sapiens
caatcacatgccaatag

SEQ ID NO: 1996 - DNA, 121 bp, Homo sapiens
tattcctactttacaggtctgattggatgccacaggaaatcagtctattggcatgtgattggaatgggcaccactcctgaagtgcactcaatattcctcgaaggtcacacatttcttgtga

SEQ ID NO: 1997 - DNA, 121 bp, Homo sapiens
tcacaagaaatgtgtgaccttcgaggaatattgagtgcacttcaggagtggtgcccattccaatcacatgccaatagactgatttcctgtggcatccaatcagacctgtaaagtaggaata

SEQ ID NO: 1998 - DNA, 17 bp, Homo sapiens
atgtgattggaatgggc

SEQ ID NO: 1999 - DNA, 17 bp, Homo sapiens
gcccattccaatcacat

SEQ ID NO: 2000 - DNA, 121 bp, Homo sapiens
ttggatgccacaggaaatcagtctattggcatgtgattggaatgggcaccactcctgaagtgcactcaatattcctcgaaggtcacacatttcttgtgaggaaccatcgccaggcgtcctt

SEQ ID NO: 2001 - DNA, 121 bp, Homo sapiens
aaggacgcctggcgatggttcctcacaagaaatgtgtgaccttcgaggaatattgagtgcacttcaggagtggtgcccattccaatcacatgccaatagactgatttcctgtggcatccaa

SEQ ID NO: 2002 - DNA, 17 bp, Homo sapiens
tcctgaagtgcactcaa

SEQ ID NO: 2003 - DNA, 17 bp, Homo sapiens
ttgagtgcacttcagga

SEQ ID NO: 2004 - DNA, 121 bp, Homo sapiens
cagtctattggcatgtgattggaatgggcaccactcctgaagtgcactcaatattcctcgaaggtcacacatttcttgtgaggaaccatcgccaggcgtccttggaaatctcgccaataac

SEQ ID NO: 2005 - DNA, 121 bp, Homo sapiens
gttattggcgagatttccaaggacgcctggcgatggttcctcacaagaaatgtgtgaccttcgaggaatattgagtgcacttcaggagtggtgcccattccaatcacatgccaatagactg

SEQ ID NO: 2006 - DNA, 17 bp, Homo sapiens
attcctcgaaggtcaca

SEQ ID NO: 2007 - DNA, 17 bp, Homo sapiens
tgtgaccttcgaggaat

SEQ ID NO: 2008 - DNA, 121 bp, Homo sapiens
tcagtctattggcatgtgattggaatgggcaccactcctgaagtgcactcaatattcctcgaaggtcacacatttcttgtgaggaaccatcgccaggcgtccttggaaatctcgccaataa

SEQ ID NO: 2009 - DNA, 121 bp, Homo sapiens
ttattggcgagatttccaaggacgcctggcgatggttcctcacaagaaatgtgtgaccttcgaggaatattgagtgcacttcaggagtggtgcccattccaatcacatgccaatagactga

SEQ ID NO: 2010 - DNA, 17 bp, Homo sapiens
tattcctcgaaggtcac

SEQ ID NO: 2011 - DNA, 17 bp, Homo sapiens
gtgaccttcgaggaata

SEQ ID NO: 2012 - DNA, 121 bp, Homo sapiens
ggcatgtgattggaatgggcaccactcctgaagtgcactcaatattcctcgaaggtcacacatttcttgtgaggaaccatcgccaggcgtccttggaaatctcgccaataactttccttac

SEQ ID NO: 2013 - DNA, 121 bp, Homo sapiens
gtaaggaaagttattggcgagatttccaaggacgcctggcgatggttcctcacaagaaatgtgtgaccttcgaggaatattgagtgcacttcaggagtggtgcccattccaatcacatgcc

SEQ ID NO: 2014 - DNA, 17 bp, Homo sapiens
aggtcacacatttcttg

SEQ ID NO: 2015 - DNA, 17 bp, Homo sapiens
caagaaatgtgtgacct

SEQ ID NO: 2016 - DNA, 121 bp, Homo sapiens
ttggaatgggcaccactcctgaagtgcactcaatattcctcgaaggtcacacatttcttgtgaggaaccatcgccaggcgtccttggaaatctcgccaataactttccttactgctcaaac

SEQ ID NO: 2017 - DNA, 121 bp, Homo sapiens
gtttgagcagtaaggaaagttattggcgagatttccaaggacgcctggcgatggttcctcacaagaaatgtgtgaccttcgaggaatattgagtgcacttcaggagtggtgcccattccaa

SEQ ID NO: 2018 - DNA, 17 bp, Homo sapiens
atttcttgtgaggaacc

SEQ ID NO: 2019 - DNA, 17 bp, Homo sapiens
ggttcctcacaagaaat

SEQ ID NO: 2020 - DNA, 121 bp, Homo sapiens
tgggcaccactcctgaagtgcactcaatattcctcgaaggtcacacatttcttgtgaggaaccatcgccaggcgtccttggaaatctcgccaataactttccttactgctcaaacactctt

SEQ ID NO: 2021 - DNA, 121 bp, Homo sapiens
aagagtgtttgagcagtaaggaaagttattggcgagatttccaaggacgcctggcgatggttcctcacaagaaatgtgtgaccttcgaggaatattgagtgcacttcaggagtggtgccca

SEQ ID NO: 2022 - DNA, 17 bp, Homo sapiens
tgtgaggaaccatcgcc

SEQ ID NO: 2023 - DNA, 17 bp, Homo sapiens
ggcgatggttcctcaca

SEQ ID NO: 2024 - DNA, 121 bp, Homo sapiens
accactcctgaagtgcactcaatattcctcgaaggtcacacatttcttgtgaggaaccatcgccaggcgtccttggaaatctcgccaataactttccttactgctcaaacactcttgatgg

SEQ ID NO: 2025 - DNA, 121 bp, Homo sapiens
ccatcaagagtgtttgagcagtaaggaaagttattggcgagatttccaaggacgcctggcgatggttcctcacaagaaatgtgtgaccttcgaggaatattgagtgcacttcaggagtggt

SEQ ID NO: 2026 - DNA, 17 bp, Homo sapiens
ggaaccatcgccaggcg

SEQ ID NO: 2027 - DNA, 17 bp, Homo sapiens
cgcctggcgatggttcc

SEQ ID NO: 2028 - DNA, 121 bp, Homo sapiens
ccactcctgaagtgcactcaatattcctcgaaggtcacacatttcttgtgaggaaccatcgccaggcgtccttggaaatctcgccaataactttccttactgctcaaacactcttgatgga

SEQ ID NO: 2029 - DNA, 121 bp, Homo sapiens
tccatcaagagtgtttgagcagtaaggaaagttattggcgagatttccaaggacgcctggcgatggttcctcacaagaaatgtgtgaccttcgaggaatattgagtgcacttcaggagtgg

SEQ ID NO: 2030 - DNA, 17 bp, Homo sapiens
gaaccatcgccaggcgt

SEQ ID NO: 2031 - DNA, 17 bp, Homo sapiens
acgcctggcgatggttc

SEQ ID NO: 2032 - DNA, 121 bp, Homo sapiens; identical to SEQ ID NO: 2028

SEQ ID NO: 2033 - DNA, 121 bp, Homo sapiens; identical to SEQ ID NO: 2029

SEQ ID NO: 2034 - DNA, 17 bp, Homo sapiens
gaaccatcgccaggcgt

SEQ ID NO: 2035 - DNA, 17 bp, Homo sapiens
acgcctggcgatggttc

SEQ ID NO: 2036 - DNA, 121 bp, Homo sapiens
ctgaagtgcactcaatattcctcgaaggtcacacatttcttgtgaggaaccatcgccaggcgtccttggaaatctcgccaataactttccttactgctcaaacactcttgatggaccttgg

SEQ ID NO: 2037 - DNA, 121 bp, Homo sapiens
ccaaggtccatcaagagtgtttgagcagtaaggaaagttattggcgagatttccaaggacgcctggcgatggttcctcacaagaaatgtgtgaccttcgaggaatattgagtgcacttcag

SEQ ID NO: 2038 - DNA, 17 bp, Homo sapiens
tcgccaggcgtccttgg

SEQ ID NO: 2039 - DNA, 17 bp, Homo sapiens
ccaaggacgcctggcga

SEQ ID NO: 2040 - DNA, 121 bp, Homo sapiens
cctgaagtgcactcaatattcctcgaaggtcacacatttcttgtgaggaaccatcgccaggcgtccttggaaatctcgccaataactttccttactgctcaaacactcttgatggaccttg

SEQ ID NO: 2041 - DNA, 121 bp, Homo sapiens
caaggtccatcaagagtgtttgagcagtaaggaaagttattggcgagatttccaaggacgcctggcgatggttcctcacaagaaatgtgtgaccttcgaggaatattgagtgcacttcagg

SEQ ID NO: 2042 - DNA, 17 bp, Homo sapiens
atcgccaggcgtccttg

SEQ ID NO: 2043 - DNA, 17 bp, Homo sapiens
caaggacgcctggcgat

SEQ ID NO: 2044 - DNA, 121 bp, Homo sapiens
tattcctcgaaggtcacacatttcttgtgaggaaccatcgccaggcgtccttggaaatctcgccaataactttccttactgctcaaacactcttgatggaccttggacagtttctactgtt

SEQ ID NO: 2045 - DNA, 121 bp, Homo sapiens
aacagtagaaactgtccaaggtccatcaagagtgtttgagcagtaaggaaagttattggcgagatttccaaggacgcctggcgatggttcctcacaagaaatgtgtgaccttcgaggaata

SEQ ID NO: 2046 - DNA, 17 bp, Homo sapiens
ggaaatctcgccaataa

SEQ ID NO: 2047 - DNA, 17 bp, Homo sapiens
ttattggcgagatttcc

SEQ ID NO: 2048 - DNA, 121 bp, Homo sapiens
gtcacacatttcttgtgaggaaccatcgccaggcgtccttggaaatctcgccaataactttccttactgctcaaacactcttgatggaccttggacagtttctactgttttgtcatatctc

SEQ ID NO: 2049 - DNA, 121 bp, Homo sapiens
gagatatgacaaaacagtagaaactgtccaaggtccatcaagagtgtttgagcagtaaggaaagttattggcgagatttccaaggacgcctggcgatggttcctcacaagaaatgtgtgac

SEQ ID NO: 2050 - DNA, 17 bp, Homo sapiens
aataactttccttactg

SEQ ID NO: 2051 - DNA, 17 bp, Homo sapiens
cagtaaggaaagttatt

SEQ ID NO: 2052 - DNA, 121 bp, Homo sapiens
acatttcttgtgaggaaccatcgccaggcgtccttggaaatctcgccaataactttccttactgctcaaacactcttgatggaccttggacagtttctactgttttgtcatatctcttccc

SEQ ID NO: 2053 - DNA, 121 bp, Homo sapiens
gggaagagatatgacaaaacagtagaaactgtccaaggtccatcaagagtgtttgagcagtaaggaaagttattggcgagatttccaaggacgcctggcgatggttcctcacaagaaatgt

SEQ ID NO: 2054 - DNA, 17 bp, Homo sapiens
ctttccttactgctcaa

SEQ ID NO: 2055 - DNA, 17 bp, Homo sapiens
ttgagcagtaaggaaag

SEQ ID NO: 2056 - DNA, 121 bp, Homo sapiens
catttcttgtgaggaaccatcgccaggcgtccttggaaatctcgccaataactttccttactgctcaaacactcttgatggaccttggacagtttctactgttttgtcatatctcttccca

SEQ ID NO: 2057 - DNA, 121 bp, Homo sapiens
tgggaagagatatgacaaaacagtagaaactgtccaaggtccatcaagagtgtttgagcagtaaggaaagttattggcgagatttccaaggacgcctggcgatggttcctcacaagaaatg

SEQ ID NO: 2058 - DNA, 17 bp, Homo sapiens
tttccttactgctcaaa

SEQ ID NO: 2059 - DNA, 17 bp, Homo sapiens
tttgagcagtaaggaaa

SEQ ID NO: 2060 - DNA, 121 bp, Homo sapiens
ttcttgtgaggaaccatcgccaggcgtccttggaaatctcgccaataactttccttactgctcaaacactcttgatggaccttggacagtttctactgttttgtcatatctcttcccacca

SEQ ID NO: 2061 - DNA, 121 bp, Homo sapiens
tggtgggaagagatatgacaaaacagtagaaactgtccaaggtccatcaagagtgtttgagcagtaaggaaagttattggcgagatttccaaggacgcctggcgatggttcctcacaagaa

SEQ ID NO: 2062 - DNA, 17 bp, Homo sapiens
ccttactgctcaaacac

SEQ ID NO: 2063 - DNA, 17 bp, Homo sapiens
gtgtttgagcagtaagg

SEQ ID NO: 2064 - DNA, 121 bp, Homo sapiens
tctcgccaataactttccttactgctcaaacactcttgatggaccttggacagtttctactgttttgtcatatctcttcccaccaacatggtaatatcttggatctttaaaatgaatatta

SEQ ID NO: 2065 - DNA, 121 bp, Homo sapiens
taatattcattttaaagatccaagatattaccatgttggtgggaagagatatgacaaaacagtagaaactgtccaaggtccatcaagagtgtttgagcagtaaggaaagttattggcgaga

SEQ ID NO: 2066 - DNA, 17 bp, Homo sapiens
gtttctactgttttgtc

SEQ ID NO: 2067 - DNA, 17 bp, Homo sapiens
gacaaaacagtagaaac

SEQ ID NO: 2068 - DNA, 121 bp, Homo sapiens
acagcctaatatagcaagacactctgacattgtttggtttgtctgactccagatggcatggaagcttatgtcaaagtagacagctgtccagaggaaccccaactacgaatgaaaaataatg

SEQ ID NO: 2069 - DNA, 121 bp, Homo sapiens
cattatttttcattcgtagttggggttcctctggacagctgtctactttgacataagcttccatgccatctggagtcagacaaaccaaacaatgtcagagtgtcttgctatattaggctgt

SEQ ID NO: 2070 - DNA, 17 bp, Homo sapiens
atggcatggaagcttat

SEQ ID NO: 2071 - DNA, 17 bp, Homo sapiens
ataagcttccatgccat

SEQ ID NO: 2072 - DNA, 121 bp, Homo sapiens
atatagcaagacactctgacattgtttggtttgtctgactccagatggcatggaagcttatgtcaaagtagacagctgtccagaggaaccccaactacgaatgaaaaataatgaagaagcg

SEQ ID NO: 2073 - DNA, 121 bp, Homo sapiens
cgcttcttcattatttttcattcgtagttggggttcctctggacagctgtctactttgacataagcttccatgccatctggagtcagacaaaccaaacaatgtcagagtgtcttgctatat

SEQ ID NO: 2074 - DNA, 17 bp, Homo sapiens
gaagcttatgtcaaagt

SEQ ID NO: 2075 - DNA, 17 bp, Homo sapiens
actttgacataagcttc

SEQ ID NO: 2076 - DNA, 121 bp, Homo sapiens
aagacactctgacattgtttggtttgtctgactccagatggcatggaagcttatgtcaaagtagacagctgtccagaggaaccccaactacgaatgaaaaataatgaagaagcggaagact

SEQ ID NO: 2077 - DNA, 121 bp, Homo sapiens
agtcttccgcttcttcattatttttcattcgtagttggggttcctctggacagctgtctactttgacataagcttccatgccatctggagtcagacaaaccaaacaatgtcagagtgtctt

SEQ ID NO: 2078 - DNA, 17 bp, Homo sapiens
atgtcaaagtagacagc

SEQ ID NO: 2079 - DNA, 17 bp, Homo sapiens
gctgtctactttgacat

SEQ ID NO: 2080 - DNA, 121 bp, Homo sapiens
tgacattgtttggtttgtctgactccagatggcatggaagcttatgtcaaagtagacagctgtccagaggaaccccaactacgaatgaaaaataatgaagaagcggaagactatgatgatg

SEQ ID NO: 2081 - DNA, 121 bp, Homo sapiens
catcatcatagtcttccgcttcttcattatttttcattcgtagttggggttcctctggacagctgtctactttgacataagcttccatgccatctggagtcagacaaaccaaacaatgtca

SEQ ID NO: 2082 - DNA, 17 bp, Homo sapiens
tagacagctgtccagag

SEQ ID NO: 2083 - DNA, 17 bp, Homo sapiens
ctctggacagctgtcta

SEQ ID NO: 2084 - DNA, 121 bp, Homo sapiens
gacattgtttggtttgtctgactccagatggcatggaagcttatgtcaaagtagacagctgtccagaggaaccccaactacgaatgaaaaataatgaagaagcggaagactatgatgatga

SEQ ID NO: 2085 - DNA, 121 bp, Homo sapiens
tcatcatcatagtcttccgcttcttcattatttttcattcgtagttggggttcctctggacagctgtctactttgacataagcttccatgccatctggagtcagacaaaccaaacaatgtc

SEQ ID NO: 2086 - DNA, 17 bp, Homo sapiens
agacagctgtccagagg

SEQ ID NO: 2087 - DNA, 17 bp, Homo sapiens
cctctggacagctgtct

SEQ ID NO: 2088 - DNA, 121 bp, Homo sapiens
actccagatggcatggaagcttatgtcaaagtagacagctgtccagaggaaccccaactacgaatgaaaaataatgaagaagcggaagactatgatgatgatcttactgattctgaaatgg

SEQ ID NO: 2089 - DNA, 121 bp, Homo sapiens
ccatttcagaatcagtaagatcatcatcatagtcttccgcttcttcattatttttcattcgtagttggggttcctctggacagctgtctactttgacataagcttccatgccatctggagt

SEQ ID NO: 2090 - DNA, 17 bp, Homo sapiens
cccaactacgaatgaaa

SEQ ID NO: 2091 - DNA, 17 bp, Homo sapiens
tttcattcgtagttggg

SEQ ID NO: 2092 - DNA, 121 bp, Homo sapiens
gattctgaaatggatgtggtcaggtttgatgatgacaactctccttcctttatccaaattcgctcagttgccaagaagcatcctaaaacttgggtacattacattgctgctgaagaggagg

SEQ ID NO: 2093 - DNA, 121 bp, Homo sapiens
cctcctcttcagcagcaatgtaatgtacccaagttttaggatgcttcttggcaactgagcgaatttggataaaggaaggagagttgtcatcatcaaacctgaccacatccatttcagaatc

SEQ ID NO: 2094 - DNA, 17 bp, Homo sapiens
tccaaattcgctcagtt

SEQ ID NO: 2095 - DNA, 17 bp, Homo sapiens
aactgagcgaatttgga

SEQ ID NO: 2096 - DNA, 121 bp, Homo sapiens
attctgaaatggatgtggtcaggtttgatgatgacaactctccttcctttatccaaattcgctcagttgccaagaagcatcctaaaacttgggtacattacattgctgctgaagaggagga

SEQ ID NO: 2097 - DNA, 121 bp, Homo sapiens
tcctcctcttcagcagcaatgtaatgtacccaagttttaggatgcttcttggcaactgagcgaatttggataaaggaaggagagttgtcatcatcaaacctgaccacatccatttcagaat

SEQ ID NO: 2098 - DNA, 17 bp, Homo sapiens
ccaaattcgctcagttg

SEQ ID NO: 2099 - DNA, 17 bp, Homo sapiens
caactgagcgaatttgg

SEQ ID NO: 2100 - DNA, 121 bp, Homo sapiens
ctgaaatggatgtggtcaggtttgatgatgacaactctccttcctttatccaaattcgctcagttgccaagaagcatcctaaaacttgggtacattacattgctgctgaagaggaggactg

SEQ ID NO: 2101 - DNA, 121 bp, Homo sapiens
cagtcctcctcttcagcagcaatgtaatgtacccaagttttaggatgcttcttggcaactgagcgaatttggataaaggaaggagagttgtcatcatcaaacctgaccacatccatttcag

SEQ ID NO: 2102 - DNA, 17 bp, Homo sapiens
aattcgctcagttgcca

SEQ ID NO: 2103 - DNA, 17 bp, Homo sapiens
tggcaactgagcgaatt

SEQ ID NO: 2104 - DNA, 121 bp, Homo sapiens
tctgaaatggatgtggtcaggtttgatgatgacaactctccttcctttatccaaattcgctcagttgccaagaagcatcctaaaacttgggtacattacattgctgctgaagaggaggact

SEQ ID NO: 2105 - DNA, 121 bp, Homo sapiens
agtcctcctcttcagcagcaatgtaatgtacccaagttttaggatgcttcttggcaactgagcgaatttggataaaggaaggagagttgtcatcatcaaacctgaccacatccatttcaga

SEQ ID NO: 2106 - DNA, 17 bp, Homo sapiens
aaattcgctcagttgcc

SEQ ID NO: 2107 - DNA, 17 bp, Homo sapiens
ggcaactgagcgaattt

SEQ ID NO: 2108 - DNA, 121 bp, Homo sapiens; identical to SEQ ID NO: 2100

SEQ ID NO: 2109 - DNA, 121 bp, Homo sapiens; identical to SEQ ID NO: 2101

SEQ ID NO: 2110 - DNA, 17 bp, Homo sapiens
aattcgctcagttgcca

SEQ ID NO: 2111 - DNA, 17 bp, Homo sapiens
tggcaactgagcgaatt

SEQ ID NO: 2112 - DNA, 121 bp, Homo sapiens
ccttcctttatccaaattcgctcagttgccaagaagcatcctaaaacttgggtacattacattgctgctgaagaggaggactgggactatgctcccttagtcctcgcccccgatgacaggt

SEQ ID NO: 2113 - DNA, 121 bp, Homo sapiens
acctgtcatcgggggcgaggactaagggagcatagtcccagtcctcctcttcagcagcaatgtaatgtacccaagttttaggatgcttcttggcaactgagcgaatttggataaaggaagg

SEQ ID NO: 2114 - DNA, 17 bp, Homo sapiens
tacattacattgctgct

SEQ ID NO: 2115 - DNA, 17 bp, Homo sapiens
agcagcaatgtaatgta

SEQ ID NO: 2116 - DNA, 121 bp, Homo sapiens
cttcctttatccaaattcgctcagttgccaagaagcatcctaaaacttgggtacattacattgctgctgaagaggaggactgggactatgctcccttagtcctcgcccccgatgacaggta

SEQ ID NO: 2117 - DNA, 121 bp, Homo sapiens
tacctgtcatcgggggcgaggactaagggagcatagtcccagtcctcctcttcagcagcaatgtaatgtacccaagttttaggatgcttcttggcaactgagcgaatttggataaaggaag

SEQ ID NO: 2118 - DNA, 17 bp, Homo sapiens
acattacattgctgctg

SEQ ID NO: 2119 - DNA, 17 bp, Homo sapiens
cagcagcaatgtaatgt

SEQ ID NO: 2120 - DNA, 121 bp, Homo sapiens
aaattcgctcagttgccaagaagcatcctaaaacttgggtacattacattgctgctgaagaggaggactgggactatgctcccttagtcctcgcccccgatgacaggtaagcactttttga

SEQ ID NO: 2121 - DNA, 121 bp, Homo sapiens
tcaaaaagtgcttacctgtcatcgggggcgaggactaagggagcatagtcccagtcctcctcttcagcagcaatgtaatgtacccaagttttaggatgcttcttggcaactgagcgaattt

SEQ ID NO: 2122 - DNA, 17 bp, Homo sapiens
tgctgaagaggaggact

SEQ ID NO: 2123 - DNA, 17 bp, Homo sapiens
agtcctcctcttcagca

SEQ ID NO: 2124 - DNA, 121 bp, Homo sapiens
tcagttgccaagaagcatcctaaaacttgggtacattacattgctgctgaagaggaggactgggactatgctcccttagtcctcgcccccgatgacaggtaagcactttttgactattggt

SEQ ID NO: 2125 - DNA, 121 bp, Homo sapiens
accaatagtcaaaaagtgcttacctgtcatcgggggcgaggactaagggagcatagtcccagtcctcctcttcagcagcaatgtaatgtacccaagttttaggatgcttcttggcaactga

SEQ ID NO: 2126 - DNA, 17 bp, Homo sapiens
aggaggactgggactat

SEQ ID NO: 2127 - DNA, 17 bp, Homo sapiens
atagtcccagtcctcct

SEQ ID NO: 2128 - DNA, 121 bp, Homo sapiens
gcctacctagaatttttcttcccaacctctcatctttttttctcttatacagaagttataaaagtcaatatttgaacaatggccctcagcggattggtaggaagtacaaaaaagtccgatt

SEQ ID NO: 2129 - DNA, 121 bp, Homo sapiens
aatcggacttttttgtacttcctaccaatccgctgagggccattgttcaaatattgacttttataacttctgtataagagaaaaaaagatgagaggttgggaagaaaaattctaggtaggc

SEQ ID NO: 2130 - DNA, 17 bp, Homo sapiens
aagttataaaagtcaat

SEQ ID NO: 2131 - DNA, 17 bp, Homo sapiens
attgacttttataactt

SEQ ID NO: 2132 - DNA, 121 bp, Homo sapiens
ttttcttcccaacctctcatctttttttctcttatacagaagttataaaagtcaatatttgaacaatggccctcagcggattggtaggaagtacaaaaaagtccgatttatggcatacaca

SEQ ID NO: 2133 - DNA, 121 bp, Homo sapiens
tgtgtatgccataaatcggacttttttgtacttcctaccaatccgctgagggccattgttcaaatattgacttttataacttctgtataagagaaaaaaagatgagaggttgggaagaaaa

SEQ ID NO: 2134 - DNA, 17 bp, Homo sapiens
caatatttgaacaatgg

SEQ ID NO: 2135 - DNA, 17 bp, Homo sapiens
ccattgttcaaatattg

SEQ ID NO: 2136 - DNA, 121 bp, Homo sapiens
tcatctttttttctcttatacagaagttataaaagtcaatatttgaacaatggccctcagcggattggtaggaagtacaaaaaagtccgatttatggcatacacagatgaaacctttaaga

SEQ ID NO: 2137 - DNA, 121 bp, Homo sapiens
tcttaaaggtttcatctgtgtatgccataaatcggacttttttgtacttcctaccaatccgctgagggccattgttcaaatattgacttttataacttctgtataagagaaaaaaagatga

SEQ ID NO: 2138 - DNA, 17 bp, Homo sapiens
gccctcagcggattggt

SEQ ID NO: 2139 - DNA, 17 bp, Homo sapiens
accaatccgctgagggc

SEQ ID NO: 2140 - DNA, 121 bp, Homo sapiens
tttttctcttatacagaagttataaaagtcaatatttgaacaatggccctcagcggattggtaggaagtacaaaaaagtccgatttatggcatacacagatgaaacctttaagactcgtga

SEQ ID NO: 2141 - DNA, 121 bp, Homo sapiens
tcacgagtcttaaaggtttcatctgtgtatgccataaatcggacttttttgtacttcctaccaatccgctgagggccattgttcaaatattgacttttataacttctgtataagagaaaaa

SEQ ID NO: 2142 - DNA, 17 bp, Homo sapiens
gcggattggtaggaagt

SEQ ID NO: 2143 - DNA, 17 bp, Homo sapiens
acttcctaccaatccgc

SEQ ID NO: 2144 - DNA, 121 bp, Homo sapiens
gaagttataaaagtcaatatttgaacaatggccctcagcggattggtaggaagtacaaaaaagtccgatttatggcatacacagatgaaacctttaagactcgtgaagctattcagcatga

SEQ ID NO: 2145 - DNA, 121 bp, Homo sapiens
tcatgctgaatagcttcacgagtcttaaaggtttcatctgtgtatgccataaatcggacttttttgtacttcctaccaatccgctgagggccattgttcaaatattgacttttataacttc

SEQ ID NO: 2146 - DNA, 17 bp, Homo sapiens
gtacaaaaaagtccgat

SEQ ID NO: 2147 - DNA, 17 bp, Homo sapiens
atcggacttttttgtac

SEQ ID NO: 2148 - DNA, 121 bp, Homo sapiens
tataaaagtcaatatttgaacaatggccctcagcggattggtaggaagtacaaaaaagtccgatttatggcatacacagatgaaacctttaagactcgtgaagctattcagcatgaatcag

SEQ ID NO: 2149 - DNA, 121 bp, Homo sapiens
ctgattcatgctgaatagcttcacgagtcttaaaggtttcatctgtgtatgccataaatcggacttttttgtacttcctaccaatccgctgagggccattgttcaaatattgacttttata

SEQ ID NO: 2150 - DNA, 17 bp, Homo sapiens
aaaaagtccgatttatg

SEQ ID NO: 2151 - DNA, 17 bp, Homo sapiens
cataaatcggacttttt

SEQ ID NO: 2152 - DNA, 121 bp, Homo sapiens
tatttgaacaatggccctcagcggattggtaggaagtacaaaaaagtccgatttatggcatacacagatgaaacctttaagactcgtgaagctattcagcatgaatcaggaatcttgggac

SEQ ID NO: 2153 - DNA, 121 bp, Homo sapiens
gtcccaagattcctgattcatgctgaatagcttcacgagtcttaaaggtttcatctgtgtatgccataaatcggacttttttgtacttcctaccaatccgctgagggccattgttcaaata

SEQ ID NO: 2154 - DNA, 17 bp, Homo sapiens
ttatggcatacacagat

SEQ ID NO: 2155 - DNA, 17 bp, Homo sapiens
atctgtgtatgccataa

SEQ ID NO: 2156 - DNA, 121 bp, Homo sapiens
gccctcagcggattggtaggaagtacaaaaaagtccgatttatggcatacacagatgaaacctttaagactcgtgaagctattcagcatgaatcaggaatcttgggacctttactttatgg

SEQ ID NO: 2157 - DNA, 121 bp, Homo sapiens
ccataaagtaaaggtcccaagattcctgattcatgctgaatagcttcacgagtcttaaaggtttcatctgtgtatgccataaatcggacttttttgtacttcctaccaatccgctgagggc

SEQ ID NO: 2158 - DNA, 17 bp, Homo sapiens
agatgaaacctttaaga

SEQ ID NO: 2159 - DNA, 17 bp, Homo sapiens
tcttaaaggtttcatct

SEQ ID NO: 2160 - DNA, 121 bp, Homo sapiens
acacagatgaaacctttaagactcgtgaagctattcagcatgaatcaggaatcttgggacctttactttatggggaagttggagacacactgttggtaagttgaagaaaagatttaaggtc

SEQ ID NO: 2161 - DNA, 121 bp, Homo sapiens
gaccttaaatcttttcttcaacttaccaacagtgtgtctccaacttccccataaagtaaaggtcccaagattcctgattcatgctgaatagcttcacgagtcttaaaggtttcatctgtgt

SEQ ID NO: 2162 - DNA, 17 bp, Homo sapiens
cttgggacctttacttt

SEQ ID NO: 2163 - DNA, 17 bp, Homo sapiens
aaagtaaaggtcccaag

SEQ ID NO: 2164 - DNA, 121 bp, Homo sapiens
tacacagatgaaacctttaagactcgtgaagctattcagcatgaatcaggaatcttgggacctttactttatggggaagttggagacacactgttggtaagttgaagaaaagatttaaggt

SEQ ID NO: 2165 - DNA, 121 bp, Homo sapiens
accttaaatcttttcttcaacttaccaacagtgtgtctccaacttccccataaagtaaaggtcccaagattcctgattcatgctgaatagcttcacgagtcttaaaggtttcatctgtgta

SEQ ID NO: 2166 - DNA, 17 bp, Homo sapiens
tcttgggacctttactt

SEQ ID NO: 2167 - DNA, 17 bp, Homo sapiens
aagtaaaggtcccaaga

SEQ ID NO: 2168 - DNA, 121 bp, Homo sapiens
acctttaagactcgtgaagctattcagcatgaatcaggaatcttgggacctttactttatggggaagttggagacacactgttggtaagttgaagaaaagatttaaggtcaggtaagaaga

SEQ ID NO: 2169 - DNA, 121 bp, Homo sapiens
tcttcttacctgaccttaaatcttttcttcaacttaccaacagtgtgtctccaacttccccataaagtaaaggtcccaagattcctgattcatgctgaatagcttcacgagtcttaaaggt

SEQ ID NO: 2170 - DNA, 17 bp, Homo sapiens
tactttatggggaagtt

SEQ ID NO: 2171 - DNA, 17 bp, Homo sapiens
aacttccccataaagta

SEQ ID NO: 2172 - DNA, 121 bp, Homo sapiens
cctttaagactcgtgaagctattcagcatgaatcaggaatcttgggacctttactttatggggaagttggagacacactgttggtaagttgaagaaaagatttaaggtcaggtaagaagaa

SEQ ID NO: 2173 - DNA, 121 bp, Homo sapiens
ttcttcttacctgaccttaaatcttttcttcaacttaccaacagtgtgtctccaacttccccataaagtaaaggtcccaagattcctgattcatgctgaatagcttcacgagtcttaaagg

SEQ ID NO: 2174 - DNA, 17 bp, Homo sapiens
actttatggggaagttg

SEQ ID NO: 2175 - DNA, 17 bp, Homo sapiens
caacttccccataaagt

SEQ ID NO: 2176 - DNA, 121 bp, Homo sapiens
cgtgaagctattcagcatgaatcaggaatcttgggacctttactttatggggaagttggagacacactgttggtaagttgaagaaaagatttaaggtcaggtaagaagaaaaagtctggag

SEQ ID NO: 2177 - DNA, 121 bp, Homo sapiens
ctccagactttttcttcttacctgaccttaaatcttttcttcaacttaccaacagtgtgtctccaacttccccataaagtaaaggtcccaagattcctgattcatgctgaatagcttcacg

SEQ ID NO: 2178 - DNA, 17 bp, Homo sapiens
aagttggagacacactg

SEQ ID NO: 2179 - DNA, 17 bp, Homo sapiens
cagtgtgtctccaactt

SEQ ID NO: 2180 - DNA, 121 bp, Homo sapiens
tgttgatcctagtcgttttaggatttgatcttagatctcgcttatactttcagattatatttaagaatcaagcaagcagaccatataacatctaccctcacggaatcactgatgtccgtcc

SEQ ID NO: 2181 - DNA, 121 bp, Homo sapiens
ggacggacatcagtgattccgtgagggtagatgttatatggtctgcttgcttgattcttaaatataatctgaaagtataagcgagatctaagatcaaatcctaaaacgactaggatcaaca

SEQ ID NO: 2182 - DNA, 17 bp, Homo sapiens
gattatatttaagaatc

SEQ ID NO: 2183 - DNA, 17 bp, Homo sapiens
gattcttaaatataatc

SEQ ID NO: 2184 - DNA, 121 bp, Homo sapiens
tcgttttaggatttgatcttagatctcgcttatactttcagattatatttaagaatcaagcaagcagaccatataacatctaccctcacggaatcactgatgtccgtcctttgtattcaag

SEQ ID NO: 2185 - DNA, 121 bp, Homo sapiens
cttgaatacaaaggacggacatcagtgattccgtgagggtagatgttatatggtctgcttgcttgattcttaaatataatctgaaagtataagcgagatctaagatcaaatcctaaaacga

SEQ ID NO: 2186 - DNA, 17 bp, Homo sapiens
gaatcaagcaagcagac

SEQ ID NO: 2187 - DNA, 17 bp, Homo sapiens
gtctgcttgcttgattc

SEQ ID NO: 2188 - DNA, 121 bp, Homo sapiens
ttaggatttgatcttagatctcgcttatactttcagattatatttaagaatcaagcaagcagaccatataacatctaccctcacggaatcactgatgtccgtcctttgtattcaaggagat

SEQ ID NO: 2189 - DNA, 121 bp, Homo sapiens
atctccttgaatacaaaggacggacatcagtgattccgtgagggtagatgttatatggtctgcttgcttgattcttaaatataatctgaaagtataagcgagatctaagatcaaatcctaa

SEQ ID NO: 2190 - DNA, 17 bp, Homo sapiens
aagcaagcagaccatat

SEQ ID NO: 2191 - DNA, 17 bp, Homo sapiens
atatggtctgcttgctt

SEQ ID NO: 2192 - DNA, 121 bp, Homo sapiens
ttgatcttagatctcgcttatactttcagattatatttaagaatcaagcaagcagaccatataacatctaccctcacggaatcactgatgtccgtcctttgtattcaaggagattaccaaa

SEQ ID NO: 2193 - DNA, 121 bp, Homo sapiens
tttggtaatctccttgaatacaaaggacggacatcagtgattccgtgagggtagatgttatatggtctgcttgcttgattcttaaatataatctgaaagtataagcgagatctaagatcaa

SEQ ID NO: 2194 - DNA, 17 bp, Homo sapiens
cagaccatataacatct

SEQ ID NO: 2195 - DNA, 17 bp, Homo sapiens
agatgttatatggtctg

SEQ ID NO: 2196 - DNA, 121 bp, Homo sapiens
tttgatcttagatctcgcttatactttcagattatatttaagaatcaagcaagcagaccatataacatctaccctcacggaatcactgatgtccgtcctttgtattcaaggagattaccaa

SEQ ID NO: 2197 - DNA, 121 bp, Homo sapiens
ttggtaatctccttgaatacaaaggacggacatcagtgattccgtgagggtagatgttatatggtctgcttgcttgattcttaaatataatctgaaagtataagcgagatctaagatcaaa

SEQ ID NO: 2198 - DNA, 17 bp, Homo sapiens
gcagaccatataacatc

SEQ ID NO: 2199 - DNA, 17 bp, Homo sapiens
gatgttatatggtctgc

SEQ ID NO: 2200 - DNA, 121 bp, Homo sapiens
ttagatctcgcttatactttcagattatatttaagaatcaagcaagcagaccatataacatctaccctcacggaatcactgatgtccgtcctttgtattcaaggagattaccaaaaggtaa

SEQ ID NO: 2201 - DNA, 121 bp, Homo sapiens
ttaccttttggtaatctccttgaatacaaaggacggacatcagtgattccgtgagggtagatgttatatggtctgcttgcttgattcttaaatataatctgaaagtataagcgagatctaa

SEQ ID NO: 2202 - DNA, 17 bp, Homo sapiens
atataacatctaccctc

SEQ ID NO: 2203 - DNA, 17 bp, Homo sapiens
gagggtagatgttatat

SEQ ID NO: 2204 - DNA, 121 bp, Homo sapiens
ttatactttcagattatatttaagaatcaagcaagcagaccatataacatctaccctcacggaatcactgatgtccgtcctttgtattcaaggagattaccaaaaggtaaatattccctcg

SEQ ID NO: 2205 - DNA, 121 bp, Homo sapiens
cgagggaatatttaccttttggtaatctccttgaatacaaaggacggacatcagtgattccgtgagggtagatgttatatggtctgcttgcttgattcttaaatataatctgaaagtataa

SEQ ID NO: 2206 - DNA, 17 bp, Homo sapiens
accctcacggaatcact

SEQ ID NO: 2207 - DNA, 17 bp, Homo sapiens
agtgattccgtgagggt

SEQ ID NO: 2208 - DNA, 121 bp, Homo sapiens
ccaattctgccaggagaaatattcaaatataaatggacagtgactgtagaagatgggccaactaaatcagatcctcggtgcctgacccgctattactctagtttcgttaatatggagagag

SEQ ID NO: 2209 - DNA, 121 bp, Homo sapiens
ctctctccatattaacgaaactagagtaatagcgggtcaggcaccgaggatctgatttagttggcccatcttctacagtcactgtccatttatatttgaatatttctcctggcagaattgg

SEQ ID NO: 2210 - DNA, 17 bp, Homo sapiens
atgggccaactaaatca

SEQ ID NO: 2211 - DNA, 17 bp, Homo sapiens
tgatttagttggcccat

SEQ ID NO: 2212 - DNA, 121 bp, Homo sapiens
ccaggagaaatattcaaatataaatggacagtgactgtagaagatgggccaactaaatcagatcctcggtgcctgacccgctattactctagtttcgttaatatggagagagatctagctt

SEQ ID NO: 2213 - DNA, 121 bp, Homo sapiens
aagctagatctctctccatattaacgaaactagagtaatagcgggtcaggcaccgaggatctgatttagttggcccatcttctacagtcactgtccatttatatttgaatatttctcctgg

SEQ ID NO: 2214 - DNA, 17 bp, Homo sapiens
ctaaatcagatcctcgg

SEQ ID NO: 2215 - DNA, 17 bp, Homo sapiens
ccgaggatctgatttag

SEQ ID NO: 2216 - DNA, 121 bp, Homo sapiens
gaaatattcaaatataaatggacagtgactgtagaagatgggccaactaaatcagatcctcggtgcctgacccgctattactctagtttcgttaatatggagagagatctagcttcaggac

SEQ ID NO: 2217 - DNA, 121 bp, Homo sapiens
gtcctgaagctagatctctctccatattaacgaaactagagtaatagcgggtcaggcaccgaggatctgatttagttggcccatcttctacagtcactgtccatttatatttgaatatttc

SEQ ID NO: 2218 - DNA, 17 bp, Homo sapiens
cagatcctcggtgcctg

SEQ ID NO: 2219 - DNA, 17 bp, Homo sapiens
caggcaccgaggatctg

SEQ ID NO: 2220 - DNA, 121 bp, Homo sapiens
tataaatggacagtgactgtagaagatgggccaactaaatcagatcctcggtgcctgacccgctattactctagtttcgttaatatggagagagatctagcttcaggactcattggccctc

SEQ ID NO: 2221 - DNA, 121 bp, Homo sapiens
gagggccaatgagtcctgaagctagatctctctccatattaacgaaactagagtaatagcgggtcaggcaccgaggatctgatttagttggcccatcttctacagtcactgtccatttata

SEQ ID NO: 2222 - DNA, 17 bp, Homo sapiens
gcctgacccgctattac

SEQ ID NO: 2223 - DNA, 17 bp, Homo sapiens
gtaatagcgggtcaggc

SEQ ID NO: 2224 - DNA, 121 bp, Homo sapiens; identical to SEQ ID NO: 2220

SEQ ID NO: 2225 - DNA, 121 bp, Homo sapiens; identical to SEQ ID NO: 2221

SEQ ID NO: 2226 - DNA, 17 bp, Homo sapiens
gcctgacccgctattac

SEQ ID NO: 2227 - DNA, 17 bp, Homo sapiens
gtaatagcgggtcaggc

SEQ ID NO: 2228 - DNA, 121 bp, Homo sapiens
ataaatggacagtgactgtagaagatgggccaactaaatcagatcctcggtgcctgacccgctattactctagtttcgttaatatggagagagatctagcttcaggactcattggccctct

SEQ ID NO: 2229 - DNA, 121 bp, Homo sapiens
agagggccaatgagtcctgaagctagatctctctccatattaacgaaactagagtaatagcgggtcaggcaccgaggatctgatttagttggcccatcttctacagtcactgtccatttat

SEQ ID NO: 2230 - DNA, 17 bp, Homo sapiens
cctgacccgctattact

SEQ ID NO: 2231 - DNA, 17 bp, Homo sapiens
agtaatagcgggtcagg

SEQ ID NO: 2232 - DNA, 121 bp, Homo sapiens
acagtgactgtagaagatgggccaactaaatcagatcctcggtgcctgacccgctattactctagtttcgttaatatggagagagatctagcttcaggactcattggccctctcctcatct

SEQ ID NO: 2233 - DNA, 121 bp, Homo sapiens
agatgaggagagggccaatgagtcctgaagctagatctctctccatattaacgaaactagagtaatagcgggtcaggcaccgaggatctgatttagttggcccatcttctacagtcactgt

SEQ ID NO: 2234 - DNA, 17 bp, Homo sapiens
gctattactctagtttc

SEQ ID NO: 2235 - DNA, 17 bp, Homo sapiens
gaaactagagtaatagc

SEQ ID NO: 2236 - DNA, 121 bp, Homo sapiens
gtgactgtagaagatgggccaactaaatcagatcctcggtgcctgacccgctattactctagtttcgttaatatggagagagatctagcttcaggactcattggccctctcctcatctgct

SEQ ID NO: 2237 - DNA, 121 bp, Homo sapiens
agcagatgaggagagggccaatgagtcctgaagctagatctctctccatattaacgaaactagagtaatagcgggtcaggcaccgaggatctgatttagttggcccatcttctacagtcac

SEQ ID NO: 2238 - DNA, 17 bp, Homo sapiens
attactctagtttcgtt

SEQ ID NO: 2239 - DNA, 17 bp, Homo sapiens
aacgaaactagagtaat

SEQ ID NO: 2240 - DNA, 121 bp, Homo sapiens
tagaagatgggccaactaaatcagatcctcggtgcctgacccgctattactctagtttcgttaatatggagagagatctagcttcaggactcattggccctctcctcatctgctacaaaga

SEQ ID NO: 2241 - DNA, 121 bp, Homo sapiens
tctttgtagcagatgaggagagggccaatgagtcctgaagctagatctctctccatattaacgaaactagagtaatagcgggtcaggcaccgaggatctgatttagttggcccatcttcta

SEQ ID NO: 2242 - DNA, 17 bp, Homo sapiens
tagtttcgttaatatgg

SEQ ID NO: 2243 - DNA, 17 bp, Homo sapiens
ccatattaacgaaacta

SEQ ID NO: 2244 - DNA, 121 bp, Homo sapiens
caactaaatcagatcctcggtgcctgacccgctattactctagtttcgttaatatggagagagatctagcttcaggactcattggccctctcctcatctgctacaaagaatctgtagatca

SEQ ID NO: 2245 - DNA, 121 bp, Homo sapiens
tgatctacagattctttgtagcagatgaggagagggccaatgagtcctgaagctagatctctctccatattaacgaaactagagtaatagcgggtcaggcaccgaggatctgatttagttg

SEQ ID NO: 2246 - DNA, 17 bp, Homo sapiens
tatggagagagatctag

SEQ ID NO: 2247 - DNA, 17 bp, Homo sapiens
ctagatctctctccata

SEQ ID NO: 2248 - DNA, 121 bp, Homo sapiens
ctaaatcagatcctcggtgcctgacccgctattactctagtttcgttaatatggagagagatctagcttcaggactcattggccctctcctcatctgctacaaagaatctgtagatcaaag

SEQ ID NO: 2249 - DNA, 121 bp, Homo sapiens
ctttgatctacagattctttgtagcagatgaggagagggccaatgagtcctgaagctagatctctctccatattaacgaaactagagtaatagcgggtcaggcaccgaggatctgatttag

SEQ ID NO: 2250 - DNA, 17 bp, Homo sapiens
ggagagagatctagctt

SEQ ID NO: 2251 - DNA, 17 bp, Homo sapiens
aagctagatctctctcc

SEQ ID NO: 2252 - DNA, 121 bp, Homo sapiens
actaaatcagatcctcggtgcctgacccgctattactctagtttcgttaatatggagagagatctagcttcaggactcattggccctctcctcatctgctacaaagaatctgtagatcaaa

SEQ ID NO: 2253 - DNA, 121 bp, Homo sapiens
tttgatctacagattctttgtagcagatgaggagagggccaatgagtcctgaagctagatctctctccatattaacgaaactagagtaatagcgggtcaggcaccgaggatctgatttagt

SEQ ID NO: 2254 - DNA, 17 bp, Homo sapiens
tggagagagatctagct

SEQ ID NO: 2255 - DNA, 17 bp, Homo sapiens
agctagatctctctcca

SEQ ID NO: 2256 - DNA, 121 bp, Homo sapiens; identical to SEQ ID NO: 2252

SEQ ID NO: 2257 - DNA, 121 bp, Homo sapiens; identical to SEQ ID NO: 2253

SEQ ID NO: 2258 - DNA, 17 bp, Homo sapiens
tggagagagatctagct

SEQ ID NO: 2259 - DNA, 17 bp, Homo sapiens
agctagatctctctcca

SEQ ID NO: 2260 - DNA, 121 bp, Homo sapiens
gttaatatggagagagatctagcttcaggactcattggccctctcctcatctgctacaaagaatctgtagatcaaagaggaaaccaggtgagttcttgcctttccaagtgctgggtttcat

SEQ ID NO: 2261 - DNA, 121 bp, Homo sapiens
atgaaacccagcacttggaaaggcaagaactcacctggtttcctctttgatctacagattctttgtagcagatgaggagagggccaatgagtcctgaagctagatctctctccatattaac

SEQ ID NO: 2262 - DNA, 17 bp, Homo sapiens
gctacaaagaatctgta

SEQ ID NO: 2263 - DNA, 17 bp, Homo sapiens
tacagattctttgtagc

SEQ ID NO: 2264 - DNA, 121 bp, Homo sapiens
atatggagagagatctagcttcaggactcattggccctctcctcatctgctacaaagaatctgtagatcaaagaggaaaccaggtgagttcttgcctttccaagtgctgggtttcattctc

SEQ ID NO: 2265 - DNA, 121 bp, Homo sapiens
gagaatgaaacccagcacttggaaaggcaagaactcacctggtttcctctttgatctacagattctttgtagcagatgaggagagggccaatgagtcctgaagctagatctctctccatat

SEQ ID NO: 2266 - DNA, 17 bp, Homo sapiens
caaagaatctgtagatc

SEQ ID NO: 2267 - DNA, 17 bp, Homo sapiens
gatctacagattctttg

SEQ ID NO: 2268 - DNA, 121 bp, Homo sapiens
tggagagagatctagcttcaggactcattggccctctcctcatctgctacaaagaatctgtagatcaaagaggaaaccaggtgagttcttgcctttccaagtgctgggtttcattctcagt

SEQ ID NO: 2269 - DNA, 121 bp, Homo sapiens
actgagaatgaaacccagcacttggaaaggcaagaactcacctggtttcctctttgatctacagattctttgtagcagatgaggagagggccaatgagtcctgaagctagatctctctcca

SEQ ID NO: 2270 - DNA, 17 bp, Homo sapiens
agaatctgtagatcaaa

SEQ ID NO: 2271 - DNA, 17 bp, Homo sapiens
tttgatctacagattct

SEQ ID NO: 2272 - DNA, 121 bp, Homo sapiens
atttcagtttttcttgatcatgaaaacgccaacaaaattctgaatcggccaaagaggtataattcaggtaaattggaagagtttgttcaagggaaccttgagagagaatgtatggaagaaa

SEQ ID NO: 2273 - DNA, 121 bp, Homo sapiens
tttcttccatacattctctctcaaggttcccttgaacaaactcttccaatttacctgaattatacctctttggccgattcagaattttgttggcgttttcatgatcaagaaaaactgaaat

SEQ ID NO: 2274 - DNA, 17 bp, Homo sapiens
agaggtataattcaggt

SEQ ID NO: 2275 - DNA, 17 bp, Homo sapiens
acctgaattatacctct

SEQ ID NO: 2276 - DNA, 121 bp, Homo sapiens
tttcagtttttcttgatcatgaaaacgccaacaaaattctgaatcggccaaagaggtataattcaggtaaattggaagagtttgttcaagggaaccttgagagagaatgtatggaagaaaa

SEQ ID NO: 2277 - DNA, 121 bp, Homo sapiens
ttttcttccatacattctctctcaaggttcccttgaacaaactcttccaatttacctgaattatacctctttggccgattcagaattttgttggcgttttcatgatcaagaaaaactgaaa

SEQ ID NO: 2278 - DNA, 17 bp, Homo sapiens
gaggtataattcaggta

SEQ ID NO: 2279 - DNA, 17 bp, Homo sapiens
tacctgaattatacctc

SEQ ID NO: 2280 - DNA, 121 bp, Homo sapiens; identical to SEQ ID NO: 2272

SEQ ID NO: 2281 - DNA, 121 bp, Homo sapiens; identical to SEQ ID NO: 2273

SEQ ID NO: 2282 - DNA, 17 bp, Homo sapiens
agaggtataattcaggt

SEQ ID NO: 2283 - DNA, 17 bp, Homo sapiens
acctgaattatacctct

SEQ ID NO: 2284 - DNA, 121 bp, Homo sapiens
tcagtttttcttgatcatgaaaacgccaacaaaattctgaatcggccaaagaggtataattcaggtaaattggaagagtttgttcaagggaaccttgagagagaatgtatggaagaaaagt

SEQ ID NO: 2285 - DNA, 121 bp, Homo sapiens
acttttcttccatacattctctctcaaggttcccttgaacaaactcttccaatttacctgaattatacctctttggccgattcagaattttgttggcgttttcatgatcaagaaaaactga

SEQ ID NO: 2286 - DNA, 17 bp, Homo sapiens
ggtataattcaggtaaa

SEQ ID NO: 2287 - DNA, 17 bp, Homo sapiens
tttacctgaattatacc

SEQ ID NO: 2288 - DNA, 121 bp, Homo sapiens
tttttcttgatcatgaaaacgccaacaaaattctgaatcggccaaagaggtataattcaggtaaattggaagagtttgttcaagggaaccttgagagagaatgtatggaagaaaagtgtag

SEQ ID NO: 2289 - DNA, 121 bp, Homo sapiens
ctacacttttcttccatacattctctctcaaggttcccttgaacaaactcttccaatttacctgaattatacctctttggccgattcagaattttgttggcgttttcatgatcaagaaaaa

SEQ ID NO: 2290 - DNA, 17 bp, Homo sapiens
taattcaggtaaattgg

SEQ ID NO: 2291 - DNA, 17 bp, Homo sapiens
ccaatttacctgaatta

SEQ ID NO: 2292 - DNA, 121 bp, Homo sapiens
gtttttcttgatcatgaaaacgccaacaaaattctgaatcggccaaagaggtataattcaggtaaattggaagagtttgttcaagggaaccttgagagagaatgtatggaagaaaagtgta

SEQ ID NO: 2293 - DNA, 121 bp, Homo sapiens
tacacttttcttccatacattctctctcaaggttcccttgaacaaactcttccaatttacctgaattatacctctttggccgattcagaattttgttggcgttttcatgatcaagaaaaac

SEQ ID NO: 2294 - DNA, 17 bp, Homo sapiens
ataattcaggtaaattg

SEQ ID NO: 2295 - DNA, 17 bp, Homo sapiens
caatttacctgaattat

SEQ ID NO: 2296 - DNA, 121 bp, Homo sapiens
tttcttgatcatgaaaacgccaacaaaattctgaatcggccaaagaggtataattcaggtaaattggaagagtttgttcaagggaaccttgagagagaatgtatggaagaaaagtgtagtt

SEQ ID NO: 2297 - DNA, 121 bp, Homo sapiens
aactacacttttcttccatacattctctctcaaggttcccttgaacaaactcttccaatttacctgaattatacctctttggccgattcagaattttgttggcgttttcatgatcaagaaa

SEQ ID NO: 2298 - DNA, 17 bp, Homo sapiens
attcaggtaaattggaa

SEQ ID NO: 2299 - DNA, 17 bp, Homo sapiens
ttccaatttacctgaat

SEQ ID NO: 2300 - DNA, 121 bp, Homo sapiens
atcatgaaaacgccaacaaaattctgaatcggccaaagaggtataattcaggtaaattggaagagtttgttcaagggaaccttgagagagaatgtatggaagaaaagtgtagttttgaaga

SEQ ID NO: 2301 - DNA, 121 bp, Homo sapiens
tcttcaaaactacacttttcttccatacattctctctcaaggttcccttgaacaaactcttccaatttacctgaattatacctctttggccgattcagaattttgttggcgttttcatgat

SEQ ID NO: 2302 - DNA, 17 bp, Homo sapiens
taaattggaagagtttg

SEQ ID NO: 2303 - DNA, 17 bp, Homo sapiens
caaactcttccaattta

SEQ ID NO: 2304 - DNA, 121 bp, Homo sapiens
gatcatgaaaacgccaacaaaattctgaatcggccaaagaggtataattcaggtaaattggaagagtttgttcaagggaaccttgagagagaatgtatggaagaaaagtgtagttttgaag

SEQ ID NO: 2305 - DNA, 121 bp, Homo sapiens
cttcaaaactacacttttcttccatacattctctctcaaggttcccttgaacaaactcttccaatttacctgaattatacctctttggccgattcagaattttgttggcgttttcatgatc

SEQ ID NO: 2306 - DNA, 17 bp, Homo sapiens
gtaaattggaagagttt

SEQ ID NO: 2307 - DNA, 17 bp, Homo sapiens
aaactcttccaatttac

SEQ ID NO: 2308 - DNA, 121 bp, Homo sapiens; identical to SEQ ID NO: 2300

SEQ ID NO: 2309 - DNA, 121 bp, Homo sapiens; identical to SEQ ID NO: 2301

SEQ ID NO: 2310 - DNA, 17 bp, Homo sapiens
taaattggaagagtttg

SEQ ID NO: 2311 - DNA, 17 bp, Homo sapiens
caaactcttccaattta

SEQ ID NO: 2312 - DNA, 121 bp, Homo sapiens
atgaaaacgccaacaaaattctgaatcggccaaagaggtataattcaggtaaattggaagagtttgttcaagggaaccttgagagagaatgtatggaagaaaagtgtagttttgaagaagc

SEQ ID NO: 2313 - DNA, 121 bp, Homo sapiens
gcttcttcaaaactacacttttcttccatacattctctctcaaggttcccttgaacaaactcttccaatttacctgaattatacctctttggccgattcagaattttgttggcgttttcat

SEQ ID NO: 2314 - DNA, 17 bp, Homo sapiens
attggaagagtttgttc

SEQ ID NO: 2315 - DNA, 17 bp, Homo sapiens
gaacaaactcttccaat

SEQ ID NO: 2316 - DNA, 121 bp, Homo sapiens; identical to SEQ ID NO: 2312

SEQ ID NO: 2317 - DNA, 121 bp, Homo sapiens; identical to SEQ ID NO: 2313

SEQ ID NO: 2318 - DNA, 17 bp, Homo sapiens
attggaagagtttgttc

SEQ ID NO: 2319 - DNA, 17 bp, Homo sapiens
gaacaaactcttccaat

SEQ ID NO: 2320 - DNA, 121 bp, Homo sapiens
aaaacgccaacaaaattctgaatcggccaaagaggtataattcaggtaaattggaagagtttgttcaagggaaccttgagagagaatgtatggaagaaaagtgtagttttgaagaagcacg

SEQ ID NO: 2321 - DNA, 121 bp, Homo sapiens
cgtgcttcttcaaaactacacttttcttccatacattctctctcaaggttcccttgaacaaactcttccaatttacctgaattatacctctttggccgattcagaattttgttggcgtttt

SEQ ID NO: 2322 - DNA, 17 bp, Homo sapiens
ggaagagtttgttcaag

SEQ ID NO: 2323 - DNA, 17 bp, Homo sapiens
cttgaacaaactcttcc

SEQ ID NO: 2324 - DNA, 121 bp, Homo sapiens
gaaaacgccaacaaaattctgaatcggccaaagaggtataattcaggtaaattggaagagtttgttcaagggaaccttgagagagaatgtatggaagaaaagtgtagttttgaagaagcac

SEQ ID NO: 2325 - DNA, 121 bp, Homo sapiens
gtgcttcttcaaaactacacttttcttccatacattctctctcaaggttcccttgaacaaactcttccaatttacctgaattatacctctttggccgattcagaattttgttggcgttttc

SEQ ID NO: 2326 - DNA, 17 bp, Homo sapiens
tggaagagtttgttcaa

SEQ ID NO: 2327 - DNA, 17 bp, Homo sapiens
ttgaacaaactcttcca

SEQ ID NO: 2328 - DNA, 121 bp, Homo sapiens
ttacatttcagtttttcttgatcatgaaaacgccaacaaaattctgaatcggccaaagaggtataattcaggtaaattggaagagtttgttcaagggaaccttgagagagaatgtatggaa

SEQ ID NO: 2329 - DNA, 121 bp, Homo sapiens
ttccatacattctctctcaaggttcccttgaacaaactcttccaatttacctgaattatacctctttggccgattcagaattttgttggcgttttcatgatcaagaaaaactgaaatgtaa

SEQ ID NO: 2330 - DNA, 17 bp, Homo sapiens
ccaaagaggtataattc

SEQ ID NO: 2331 - DNA, 17 bp, Homo sapiens
gaattatacctctttgg

SEQ ID NO: 2332 - DNA, 121 bp, Homo sapiens
tttacatttcagtttttcttgatcatgaaaacgccaacaaaattctgaatcggccaaagaggtataattcaggtaaattggaagagtttgttcaagggaaccttgagagagaatgtatgga

SEQ ID NO: 2333 - DNA, 121 bp, Homo sapiens
tccatacattctctctcaaggttcccttgaacaaactcttccaatttacctgaattatacctctttggccgattcagaattttgttggcgttttcatgatcaagaaaaactgaaatgtaaa

SEQ ID NO: 2334 - DNA, 17 bp, Homo sapiens
gccaaagaggtataatt

SEQ ID NO: 2335 - DNA, 17 bp, Homo sapiens
aattatacctctttggc

SEQ ID NO: 2336 - DNA, 121 bp, Homo sapiens
cttttacatttcagtttttcttgatcatgaaaacgccaacaaaattctgaatcggccaaagaggtataattcaggtaaattggaagagtttgttcaagggaaccttgagagagaatgtatg

SEQ ID NO: 2337 - DNA, 121 bp, Homo sapiens
catacattctctctcaaggttcccttgaacaaactcttccaatttacctgaattatacctctttggccgattcagaattttgttggcgttttcatgatcaagaaaaactgaaatgtaaaag

SEQ ID NO: 2338 - DNA, 17 bp, Homo sapiens
cggccaaagaggtataa

SEQ ID NO: 2339 - DNA, 17 bp, Homo sapiens
ttatacctctttggccg

SEQ ID NO: 2340 - DNA, 121 bp, Homo sapiens
aattattcttttacatttcagtttttcttgatcatgaaaacgccaacaaaattctgaatcggccaaagaggtataattcaggtaaattggaagagtttgttcaagggaaccttgagagaga

SEQ ID NO: 2341 - DNA, 121 bp, Homo sapiens
tctctctcaaggttcccttgaacaaactcttccaatttacctgaattatacctctttggccgattcagaattttgttggcgttttcatgatcaagaaaaactgaaatgtaaaagaataatt

SEQ ID NO: 2342 - DNA, 17 bp, Homo sapiens
tctgaatcggccaaaga

SEQ ID NO: 2343 - DNA, 17 bp, Homo sapiens
tctttggccgattcaga

SEQ ID NO: 2344 - DNA, 121 bp, Homo sapiens; identical to SEQ ID NO: 2340

SEQ ID NO: 2345 - DNA, 121 bp, Homo sapiens; identical to SEQ ID NO: 2341

SEQ ID NO: 2346 - DNA, 17 bp, Homo sapiens
tctgaatcggccaaaga

SEQ ID NO: 2347 - DNA, 17 bp, Homo sapiens
tctttggccgattcaga

SEQ ID NO: 2348 - DNA, 121 bp, Homo sapiens
gaattattcttttacatttcagtttttcttgatcatgaaaacgccaacaaaattctgaatcggccaaagaggtataattcaggtaaattggaagagtttgttcaagggaaccttgagagag

SEQ ID NO: 2349 - DNA, 121 bp, Homo sapiens
ctctctcaaggttcccttgaacaaactcttccaatttacctgaattatacctctttggccgattcagaattttgttggcgttttcatgatcaagaaaaactgaaatgtaaaagaataattc

SEQ ID NO: 2350 - DNA, 17 bp, Homo sapiens
ttctgaatcggccaaag

SEQ ID NO: 2351 - DNA, 17 bp, Homo sapiens
ctttggccgattcagaa

SEQ ID NO: 2352 - DNA, 121 bp, Homo sapiens
gccaacaaaattctgaatcggccaaagaggtataattcaggtaaattggaagagtttgttcaagggaaccttgagagagaatgtatggaagaaaagtgtagttttgaagaagcacgagaag

SEQ ID NO: 2353 - DNA, 121 bp, Homo sapiens
cttctcgtgcttcttcaaaactacacttttcttccatacattctctctcaaggttcccttgaacaaactcttccaatttacctgaattatacctctttggccgattcagaattttgttggc

SEQ ID NO: 2354 - DNA, 17 bp, Homo sapiens
agtttgttcaagggaac

SEQ ID NO: 2355 - DNA, 17 bp, Homo sapiens
gttcccttgaacaaact

SEQ ID NO: 2356 - DNA, 121 bp, Homo sapiens
acaaaattctgaatcggccaaagaggtataattcaggtaaattggaagagtttgttcaagggaaccttgagagagaatgtatggaagaaaagtgtagttttgaagaagcacgagaagtttt

SEQ ID NO: 2357 - DNA, 121 bp, Homo sapiens
aaaacttctcgtgcttcttcaaaactacacttttcttccatacattctctctcaaggttcccttgaacaaactcttccaatttacctgaattatacctctttggccgattcagaattttgt

SEQ ID NO: 2358 - DNA, 17 bp, Homo sapiens
tgttcaagggaaccttg

SEQ ID NO: 2359 - DNA, 17 bp, Homo sapiens
caaggttcccttgaaca

SEQ ID NO: 2360 - DNA, 121 bp, Homo sapiens
aacaaaattctgaatcggccaaagaggtataattcaggtaaattggaagagtttgttcaagggaaccttgagagagaatgtatggaagaaaagtgtagttttgaagaagcacgagaagttt

SEQ ID NO: 2361 - DNA, 121 bp, Homo sapiens
aaacttctcgtgcttcttcaaaactacacttttcttccatacattctctctcaaggttcccttgaacaaactcttccaatttacctgaattatacctctttggccgattcagaattttgtt

SEQ ID NO: 2362 - DNA, 17 bp, Homo sapiens
ttgttcaagggaacctt

SEQ ID NO: 2363 - DNA, 17 bp, Homo sapiens
aaggttcccttgaacaa

SEQ ID NO: 2364 - DNA, 121 bp, Homo sapiens; identical to SEQ ID NO: 2356

SEQ ID NO: 2365 - DNA, 121 bp, Homo sapiens; identical to SEQ ID NO: 2357

SEQ ID NO: 2366 - DNA, 17 bp, Homo sapiens
tgttcaagggaaccttg

SEQ ID NO: 2367 - DNA, 17 bp, Homo sapiens
caaggttcccttgaaca

SEQ ID NO: 2368 - DNA, 121 bp, Homo sapiens
cggccaaagaggtataattcaggtaaattggaagagtttgttcaagggaaccttgagagagaatgtatggaagaaaagtgtagttttgaagaagcacgagaagtttttgaaaacactgaaa

SEQ ID NO: 2369 - DNA, 121 bp, Homo sapiens
tttcagtgttttcaaaaacttctcgtgcttcttcaaaactacacttttcttccatacattctctctcaaggttcccttgaacaaactcttccaatttacctgaattatacctctttggccg

SEQ ID NO: 2370 - DNA, 17 bp, Homo sapiens
ttgagagagaatgtatg

SEQ ID NO: 2371 - DNA, 17 bp, Homo sapiens
catacattctctctcaa

SEQ ID NO: 2372 - DNA, 121 bp, Homo sapiens; identical to SEQ ID NO: 2368

SEQ ID NO: 2373 - DNA, 121 bp, Homo sapiens; identical to SEQ ID NO: 2369

SEQ ID NO: 2374 - DNA, 17 bp, Homo sapiens
ttgagagagaatgtatg

SEQ ID NO: 2375 - DNA, 17 bp, Homo sapiens
catacattctctctcaa

SEQ ID NO: 2376 - DNA, 121 bp, Homo sapiens
ccaaagaggtataattcaggtaaattggaagagtttgttcaagggaaccttgagagagaatgtatggaagaaaagtgtagttttgaagaagcacgagaagtttttgaaaacactgaaagaa

SEQ ID NO: 2377 - DNA, 121 bp, Homo sapiens
ttctttcagtgttttcaaaaacttctcgtgcttcttcaaaactacacttttcttccatacattctctctcaaggttcccttgaacaaactcttccaatttacctgaattatacctctttgg

SEQ ID NO: 2378 - DNA, 17 bp, Homo sapiens
agagagaatgtatggaa

SEQ ID NO: 2379 - DNA, 17 bp, Homo sapiens
ttccatacattctctct

SEQ ID NO: 2380 - DNA, 121 bp, Homo sapiens
caaagaggtataattcaggtaaattggaagagtttgttcaagggaaccttgagagagaatgtatggaagaaaagtgtagttttgaagaagcacgagaagtttttgaaaacactgaaagaac

SEQ ID NO: 2381 - DNA, 121 bp, Homo sapiens
gttctttcagtgttttcaaaaacttctcgtgcttcttcaaaactacacttttcttccatacattctctctcaaggttcccttgaacaaactcttccaatttacctgaattatacctctttg

SEQ ID NO: 2382 - DNA, 17 bp, Homo sapiens
gagagaatgtatggaag

SEQ ID NO: 2383 - DNA, 17 bp, Homo sapiens
cttccatacattctctc

SEQ ID NO: 2384 - DNA, 121 bp, Homo sapiens
ggtataattcaggtaaattggaagagtttgttcaagggaaccttgagagagaatgtatggaagaaaagtgtagttttgaagaagcacgagaagtttttgaaaacactgaaagaacagtgag

SEQ ID NO: 2385 - DNA, 121 bp, Homo sapiens
ctcactgttctttcagtgttttcaaaaacttctcgtgcttcttcaaaactacacttttcttccatacattctctctcaaggttcccttgaacaaactcttccaatttacctgaattatacc

SEQ ID NO: 2386 - DNA, 17 bp, Homo sapiens
atgtatggaagaaaagt

SEQ ID NO: 2387 - DNA, 17 bp, Homo sapiens
acttttcttccatacat

SEQ ID NO: 2388 - DNA, 121 bp, Homo sapiens
tataattcaggtaaattggaagagtttgttcaagggaaccttgagagagaatgtatggaagaaaagtgtagttttgaagaagcacgagaagtttttgaaaacactgaaagaacagtgagta

SEQ ID NO: 2389 - DNA, 121 bp, Homo sapiens
tactcactgttctttcagtgttttcaaaaacttctcgtgcttcttcaaaactacacttttcttccatacattctctctcaaggttcccttgaacaaactcttccaatttacctgaattata

SEQ ID NO: 2390 - DNA, 17 bp, Homo sapiens
gtatggaagaaaagtgt

SEQ ID NO: 2391 - DNA, 17 bp, Homo sapiens
acacttttcttccatac

SEQ ID NO: 2392 - DNA, 121 bp, Homo sapiens
tcaggtaaattggaagagtttgttcaagggaaccttgagagagaatgtatggaagaaaagtgtagttttgaagaagcacgagaagtttttgaaaacactgaaagaacagtgagtatttcca

SEQ ID NO: 2393 - DNA, 121 bp, Homo sapiens
tggaaatactcactgttctttcagtgttttcaaaaacttctcgtgcttcttcaaaactacacttttcttccatacattctctctcaaggttcccttgaacaaactcttccaatttacctga

SEQ ID NO: 2394 - DNA, 17 bp, Homo sapiens
aagaaaagtgtagtttt

SEQ ID NO: 2395 - DNA, 17 bp, Homo sapiens
aaaactacacttttctt

SEQ ID NO: 2396 - DNA, 121 bp, Homo sapiens
caggtaaattggaagagtttgttcaagggaaccttgagagagaatgtatggaagaaaagtgtagttttgaagaagcacgagaagtttttgaaaacactgaaagaacagtgagtatttccac

SEQ ID NO: 2397 - DNA, 121 bp, Homo sapiens
gtggaaatactcactgttctttcagtgttttcaaaaacttctcgtgcttcttcaaaactacacttttcttccatacattctctctcaaggttcccttgaacaaactcttccaatttacctg

SEQ ID NO: 2398 - DNA, 17 bp, Homo sapiens
agaaaagtgtagttttg

SEQ ID NO: 2399 - DNA, 17 bp, Homo sapiens
caaaactacacttttct

SEQ ID NO: 2400 - DNA, 121 bp, Homo sapiens
aattggaagagtttgttcaagggaaccttgagagagaatgtatggaagaaaagtgtagttttgaagaagcacgagaagtttttgaaaacactgaaagaacagtgagtatttccacataata

SEQ ID NO: 2401 - DNA, 121 bp, Homo sapiens
tattatgtggaaatactcactgttctttcagtgttttcaaaaacttctcgtgcttcttcaaaactacacttttcttccatacattctctctcaaggttcccttgaacaaactcttccaatt

SEQ ID NO: 2402 - DNA, 17 bp, Homo sapiens
gtgtagttttgaagaag

SEQ ID NO: 2403 - DNA, 17 bp, Homo sapiens
cttcttcaaaactacac

SEQ ID NO: 2404 - DNA, 121 bp, Homo sapiens
ttggaagagtttgttcaagggaaccttgagagagaatgtatggaagaaaagtgtagttttgaagaagcacgagaagtttttgaaaacactgaaagaacagtgagtatttccacataatacc

SEQ ID NO: 2405 - DNA, 121 bp, Homo sapiens
ggtattatgtggaaatactcactgttctttcagtgttttcaaaaacttctcgtgcttcttcaaaactacacttttcttccatacattctctctcaaggttcccttgaacaaactcttccaa

SEQ ID NO: 2406 - DNA, 17 bp, Homo sapiens
gtagttttgaagaagca

SEQ ID NO: 2407 - DNA, 17 bp, Homo sapiens
tgcttcttcaaaactac

SEQ ID NO: 2408 - DNA, 121 bp, Homo sapiens
aagagtttgttcaagggaaccttgagagagaatgtatggaagaaaagtgtagttttgaagaagcacgagaagtttttgaaaacactgaaagaacagtgagtatttccacataatacccttc

SEQ ID NO: 2409 - DNA, 121 bp, Homo sapiens
gaagggtattatgtggaaatactcactgttctttcagtgttttcaaaaacttctcgtgcttcttcaaaactacacttttcttccatacattctctctcaaggttcccttgaacaaactctt

SEQ ID NO: 2410 - DNA, 17 bp, Homo sapiens
ttttgaagaagcacgag

SEQ ID NO: 2411 - DNA, 17 bp, Homo sapiens
ctcgtgcttcttcaaaa

SEQ ID NO: 2412 - DNA, 121 bp, Homo sapiens
agagtttgttcaagggaaccttgagagagaatgtatggaagaaaagtgtagttttgaagaagcacgagaagtttttgaaaacactgaaagaacagtgagtatttccacataatacccttca

SEQ ID NO: 2413 - DNA, 121 bp, Homo sapiens
tgaagggtattatgtggaaatactcactgttctttcagtgttttcaaaaacttctcgtgcttcttcaaaactacacttttcttccatacattctctctcaaggttcccttgaacaaactct

SEQ ID NO: 2414 - DNA, 17 bp, Homo sapiens
tttgaagaagcacgaga

SEQ ID NO: 2415 - DNA, 17 bp, Homo sapiens
tctcgtgcttcttcaaa

SEQ ID NO: 2416 - DNA, 121 bp, Homo sapiens
gaagagtttgttcaagggaaccttgagagagaatgtatggaagaaaagtgtagttttgaagaagcacgagaagtttttgaaaacactgaaagaacagtgagtatttccacataataccctt

SEQ ID NO: 2417 - DNA, 121 bp, Homo sapiens
aagggtattatgtggaaatactcactgttctttcagtgttttcaaaaacttctcgtgcttcttcaaaactacacttttcttccatacattctctctcaaggttcccttgaacaaactcttc

SEQ ID NO: 2418 - DNA, 17 bp, Homo sapiens
gttttgaagaagcacga

SEQ ID NO: 2419 - DNA, 17 bp, Homo sapiens
tcgtgcttcttcaaaac

SEQ ID NO: 2420 - DNA, 121 bp, Homo sapiens; identical to SEQ ID NO: 2408

SEQ ID NO: 2421 - DNA, 121 bp, Homo sapiens; identical to SEQ ID NO: 2409

SEQ ID NO: 2422 - DNA, 17 bp, Homo sapiens
ttttgaagaagcacgag

SEQ ID NO: 2423 - DNA, 17 bp, Homo sapiens
ctcgtgcttcttcaaaa

SEQ ID NO: 2424 - DNA, 121 bp, Homo sapiens
ttgttcaagggaaccttgagagagaatgtatggaagaaaagtgtagttttgaagaagcacgagaagtttttgaaaacactgaaagaacagtgagtatttccacataatacccttcagatgc

SEQ ID NO: 2425 - DNA, 121 bp, Homo sapiens
gcatctgaagggtattatgtggaaatactcactgttctttcagtgttttcaaaaacttctcgtgcttcttcaaaactacacttttcttccatacattctctctcaaggttcccttgaacaa

SEQ ID NO: 2426 - DNA, 17 bp, Homo sapiens
agaagcacgagaagttt

SEQ ID NO: 2427 - DNA, 17 bp, Homo sapiens
aaacttctcgtgcttct

SEQ ID NO: 2428 - DNA, 121 bp, Homo sapiens; identical to SEQ ID NO: 2424

SEQ ID NO: 2429 - DNA, 121 bp, Homo sapiens; identical to SEQ ID NO: 2425

SEQ ID NO: 2430 - DNA, 17 bp, Homo sapiens
agaagcacgagaagttt

SEQ ID NO: 2431 - DNA, 17 bp, Homo sapiens
aaacttctcgtgcttct

SEQ ID NO: 2432 - DNA, 121 bp, Homo sapiens
tttgttcaagggaaccttgagagagaatgtatggaagaaaagtgtagttttgaagaagcacgagaagtttttgaaaacactgaaagaacagtgagtatttccacataatacccttcagatg

SEQ ID NO: 2433 - DNA, 121 bp, Homo sapiens
catctgaagggtattatgtggaaatactcactgttctttcagtgttttcaaaaacttctcgtgcttcttcaaaactacacttttcttccatacattctctctcaaggttcccttgaacaaa

SEQ ID NO: 2434 - DNA, 17 bp, Homo sapiens
aagaagcacgagaagtt

SEQ ID NO: 2435 - DNA, 17 bp, Homo sapiens
aacttctcgtgcttctt

SEQ ID NO: 2436 - DNA, 121 bp, Homo sapiens
gttcaagggaaccttgagagagaatgtatggaagaaaagtgtagttttgaagaagcacgagaagtttttgaaaacactgaaagaacagtgagtatttccacataatacccttcagatgcag

SEQ ID NO: 2437 - DNA, 121 bp, Homo sapiens
ctgcatctgaagggtattatgtggaaatactcactgttctttcagtgttttcaaaaacttctcgtgcttcttcaaaactacacttttcttccatacattctctctcaaggttcccttgaac

SEQ ID NO: 2438 - DNA, 17 bp, Homo sapiens
aagcacgagaagttttt

SEQ ID NO: 2439 - DNA, 17 bp, Homo sapiens
aaaaacttctcgtgctt

SEQ ID NO: 2440 - DNA, 121 bp, Homo sapiens; identical to SEQ ID NO: 2436

SEQ ID NO: 2441 - DNA, 121 bp, Homo sapiens; identical to SEQ ID NO: 2437

SEQ ID NO: 2442 - DNA, 17 bp, Homo sapiens
aagcacgagaagttttt

SEQ ID NO: 2443 - DNA, 17 bp, Homo sapiens
aaaaacttctcgtgctt

SEQ ID NO: 2444 - DNA, 121 bp, Homo sapiens
ccttgagagagaatgtatggaagaaaagtgtagttttgaagaagcacgagaagtttttgaaaacactgaaagaacagtgagtatttccacataatacccttcagatgcagagcatagaata

SEQ ID NO: 2445 - DNA, 121 bp, Homo sapiens
tattctatgctctgcatctgaagggtattatgtggaaatactcactgttctttcagtgttttcaaaaacttctcgtgcttcttcaaaactacacttttcttccatacattctctctcaagg

SEQ ID NO: 2446 - DNA, 17 bp, Homo sapiens
gtttttgaaaacactga

SEQ ID NO: 2447 - DNA, 17 bp, Homo sapiens
tcagtgttttcaaaaac

SEQ ID NO: 2448 - DNA, 121 bp, Homo sapiens
aaccttgagagagaatgtatggaagaaaagtgtagttttgaagaagcacgagaagtttttgaaaacactgaaagaacagtgagtatttccacataatacccttcagatgcagagcatagaa

SEQ ID NO: 2449 - DNA, 121 bp, Homo sapiens
ttctatgctctgcatctgaagggtattatgtggaaatactcactgttctttcagtgttttcaaaaacttctcgtgcttcttcaaaactacacttttcttccatacattctctctcaaggtt

SEQ ID NO: 2450 - DNA, 17 bp, Homo sapiens
aagtttttgaaaacact

SEQ ID NO: 2451 - DNA, 17 bp, Homo sapiens
agtgttttcaaaaactt

SEQ ID NO: 2452 - DNA, 121 bp, Homo sapiens
caaaacactttagatattaccgttaatttgtcttcttttattctttatagactgaattttggaagcagtatgttggtaagcaattcattttatcctctagctaatatatgaaacatatgag

SEQ ID NO: 2453 - DNA, 121 bp, Homo sapiens
ctcatatgtttcatatattagctagaggataaaatgaattgcttaccaacatactgcttccaaaattcagtctataaagaataaaagaagacaaattaacggtaatatctaaagtgttttg

SEQ ID NO: 2454 - DNA, 17 bp, Homo sapiens
tgaattttggaagcagt

SEQ ID NO: 2455 - DNA, 17 bp, Homo sapiens
actgcttccaaaattca

SEQ ID NO: 2456 - DNA, 121 bp, Homo sapiens
aaacactttagatattaccgttaatttgtcttcttttattctttatagactgaattttggaagcagtatgttggtaagcaattcattttatcctctagctaatatatgaaacatatgagaa

SEQ ID NO: 2457 - DNA, 121 bp, Homo sapiens
ttctcatatgtttcatatattagctagaggataaaatgaattgcttaccaacatactgcttccaaaattcagtctataaagaataaaagaagacaaattaacggtaatatctaaagtgttt

SEQ ID NO: 2458 - DNA, 17 bp, Homo sapiens
aattttggaagcagtat

SEQ ID NO: 2459 - DNA, 17 bp, Homo sapiens
atactgcttccaaaatt

SEQ ID NO: 2460 - DNA, 121 bp, Homo sapiens
cactttagatattaccgttaatttgtcttcttttattctttatagactgaattttggaagcagtatgttggtaagcaattcattttatcctctagctaatatatgaaacatatgagaatta

SEQ ID NO: 2461 - DNA, 121 bp, Homo sapiens
taattctcatatgtttcatatattagctagaggataaaatgaattgcttaccaacatactgcttccaaaattcagtctataaagaataaaagaagacaaattaacggtaatatctaaagtg

SEQ ID NO: 2462 - DNA, 17 bp, Homo sapiens
tttggaagcagtatgtt

SEQ ID NO: 2463 - DNA, 17 bp, Homo sapiens
aacatactgcttccaaa

SEQ ID NO: 2464 - DNA, 121 bp, Homo sapiens
ccgggcattctaagcagtttacgtgccaattcaatttcttaacctatctcaaagatggagatcagtgtgagtccaatccatgtttaaatggcggcagttgcaaggatgacattaattccta

SEQ ID NO: 2465 - DNA, 121 bp, Homo sapiens
taggaattaatgtcatccttgcaactgccgccatttaaacatggattggactcacactgatctccatctttgagataggttaagaaattgaattggcacgtaaactgcttagaatgcccgg

SEQ ID NO: 2466 - DNA, 17 bp, Homo sapiens
agatggagatcagtgtg

SEQ ID NO: 2467 - DNA, 17 bp, Homo sapiens
cacactgatctccatct

SEQ ID NO: 2468 - DNA, 121 bp, Homo sapiens
gcattctaagcagtttacgtgccaattcaatttcttaacctatctcaaagatggagatcagtgtgagtccaatccatgtttaaatggcggcagttgcaaggatgacattaattcctatgaa

SEQ ID NO: 2469 - DNA, 121 bp, Homo sapiens
ttcataggaattaatgtcatccttgcaactgccgccatttaaacatggattggactcacactgatctccatctttgagataggttaagaaattgaattggcacgtaaactgcttagaatgc

SEQ ID NO: 2470 - DNA, 17 bp, Homo sapiens
ggagatcagtgtgagtc

SEQ ID NO: 2471 - DNA, 17 bp, Homo sapiens
gactcacactgatctcc

SEQ ID NO: 2472 - DNA, 121 bp, Homo sapiens
ggcattctaagcagtttacgtgccaattcaatttcttaacctatctcaaagatggagatcagtgtgagtccaatccatgtttaaatggcggcagttgcaaggatgacattaattcctatga

SEQ ID NO: 2473 - DNA, 121 bp, Homo sapiens
tcataggaattaatgtcatccttgcaactgccgccatttaaacatggattggactcacactgatctccatctttgagataggttaagaaattgaattggcacgtaaactgcttagaatgcc

SEQ ID NO: 2474 - DNA, 17 bp, Homo sapiens
tggagatcagtgtgagt

SEQ ID NO: 2475 - DNA, 17 bp, Homo sapiens
actcacactgatctcca

SEQ ID NO: 2476 - DNA, 121 bp, Homo sapiens
gggcattctaagcagtttacgtgccaattcaatttcttaacctatctcaaagatggagatcagtgtgagtccaatccatgtttaaatggcggcagttgcaaggatgacattaattcctatg

SEQ ID NO: 2477 - DNA, 121 bp, Homo sapiens
cataggaattaatgtcatccttgcaactgccgccatttaaacatggattggactcacactgatctccatctttgagataggttaagaaattgaattggcacgtaaactgcttagaatgccc

SEQ ID NO: 2478 - DNA, 17 bp, Homo sapiens
atggagatcagtgtgag

SEQ ID NO: 2479 - DNA, 17 bp, Homo sapiens
ctcacactgatctccat

SEQ ID NO: 2480 - DNA, 121 bp, Homo sapiens
cattctaagcagtttacgtgccaattcaatttcttaacctatctcaaagatggagatcagtgtgagtccaatccatgtttaaatggcggcagttgcaaggatgacattaattcctatgaat

SEQ ID NO: 2481 - DNA, 121 bp, Homo sapiens
attcataggaattaatgtcatccttgcaactgccgccatttaaacatggattggactcacactgatctccatctttgagataggttaagaaattgaattggcacgtaaactgcttagaatg

SEQ ID NO: 2482 - DNA, 17 bp, Homo sapiens
gagatcagtgtgagtcc

SEQ ID NO: 2483 - DNA, 17 bp, Homo sapiens
ggactcacactgatctc

SEQ ID NO: 2484 - DNA, 121 bp, Homo sapiens; identical to SEQ ID NO: 2480

SEQ ID NO: 2485 - DNA, 121 bp, Homo sapiens; identical to SEQ ID NO: 2481

SEQ ID NO: 2486 - DNA, 17 bp, Homo sapiens
gagatcagtgtgagtcc

SEQ ID NO: 2487 - DNA, 17 bp, Homo sapiens
ggactcacactgatctc

SEQ ID NO: 2488 - DNA, 121 bp, Homo sapiens
ttctaagcagtttacgtgccaattcaatttcttaacctatctcaaagatggagatcagtgtgagtccaatccatgtttaaatggcggcagttgcaaggatgacattaattcctatgaatgt

SEQ ID NO: 2489 - DNA, 121 bp, Homo sapiens
acattcataggaattaatgtcatccttgcaactgccgccatttaaacatggattggactcacactgatctccatctttgagataggttaagaaattgaattggcacgtaaactgcttagaa

SEQ ID NO: 2490 - DNA, 17 bp, Homo sapiens
gatcagtgtgagtccaa

SEQ ID NO: 2491 - DNA, 17 bp, Homo sapiens
ttggactcacactgatc

SEQ ID NO: 2492 - DNA, 121 bp, Homo sapiens
tctaagcagtttacgtgccaattcaatttcttaacctatctcaaagatggagatcagtgtgagtccaatccatgtttaaatggcggcagttgcaaggatgacattaattcctatgaatgtt

SEQ ID NO: 2493 - DNA, 121 bp, Homo sapiens
aacattcataggaattaatgtcatccttgcaactgccgccatttaaacatggattggactcacactgatctccatctttgagataggttaagaaattgaattggcacgtaaactgcttaga

SEQ ID NO: 2494 - DNA, 17 bp, Homo sapiens
atcagtgtgagtccaat

SEQ ID NO: 2495 - DNA, 17 bp, Homo sapiens
attggactcacactgat

SEQ ID NO: 2496 - DNA, 121 bp, Homo sapiens
tttacgtgccaattcaatttcttaacctatctcaaagatggagatcagtgtgagtccaatccatgtttaaatggcggcagttgcaaggatgacattaattcctatgaatgttggtgtccct

SEQ ID NO: 2497 - DNA, 121 bp, Homo sapiens
agggacaccaacattcataggaattaatgtcatccttgcaactgccgccatttaaacatggattggactcacactgatctccatctttgagataggttaagaaattgaattggcacgtaaa

SEQ ID NO: 2498 - DNA, 17 bp, Homo sapiens
agtccaatccatgttta

SEQ ID NO: 2499 - DNA, 17 bp, Homo sapiens
taaacatggattggact

SEQ ID NO: 2500 - DNA, 121 bp, Homo sapiens
ttacgtgccaattcaatttcttaacctatctcaaagatggagatcagtgtgagtccaatccatgtttaaatggcggcagttgcaaggatgacattaattcctatgaatgttggtgtccctt

SEQ ID NO: 2501 - DNA, 121 bp, Homo sapiens
aagggacaccaacattcataggaattaatgtcatccttgcaactgccgccatttaaacatggattggactcacactgatctccatctttgagataggttaagaaattgaattggcacgtaa

SEQ ID NO: 2502 - DNA, 17 bp, Homo sapiens
gtccaatccatgtttaa

SEQ ID NO: 2503 - DNA, 17 bp, Homo sapiens
ttaaacatggattggac

SEQ ID NO: 2504 - DNA, 121 bp, Homo sapiens; identical to SEQ ID NO: 2500

SEQ ID NO: 2505 - DNA, 121 bp, Homo sapiens; identical to SEQ ID NO: 2501

SEQ ID NO: 2506 - DNA, 17 bp, Homo sapiens
gtccaatccatgtttaa

SEQ ID NO: 2507 - DNA, 17 bp, Homo sapiens
ttaaacatggattggac

SEQ ID NO: 2508 - DNA, 121 bp, Homo sapiens; identical to SEQ ID NO: 2500

SEQ ID NO: 2509 - DNA, 121 bp, Homo sapiens; identical to SEQ ID NO: 2501

SEQ ID NO: 2510 - DNA, 17 bp, Homo sapiens
gtccaatccatgtttaa

SEQ ID NO: 2511 - DNA, 17 bp, Homo sapiens
ttaaacatggattggac

SEQ ID NO: 2512 - DNA, 121 bp, Homo sapiens; identical to SEQ ID NO: 2496

SEQ ID NO: 2513 - DNA, 121 bp, Homo sapiens; identical to SEQ ID NO: 2497

SEQ ID NO: 2514 - DNA, 17 bp, Homo sapiens
agtccaatccatgttta

SEQ ID NO: 2515 - DNA, 17 bp, Homo sapiens
taaacatggattggact

SEQ ID NO: 2516 - DNA, 121 bp, Homo sapiens
acgtgccaattcaatttcttaacctatctcaaagatggagatcagtgtgagtccaatccatgtttaaatggcggcagttgcaaggatgacattaattcctatgaatgttggtgtccctttg

SEQ ID NO: 2517 - DNA, 121 bp, Homo sapiens
caaagggacaccaacattcataggaattaatgtcatccttgcaactgccgccatttaaacatggattggactcacactgatctccatctttgagataggttaagaaattgaattggcacgt

SEQ ID NO: 2518 - DNA, 17 bp, Homo sapiens
ccaatccatgtttaaat

SEQ ID NO: 2519 - DNA, 17 bp, Homo sapiens
atttaaacatggattgg

SEQ ID NO: 2520 - DNA, 121 bp, Homo sapiens; identical to SEQ ID NO: 2516

SEQ ID NO: 2521 - DNA, 121 bp, Homo sapiens; identical to SEQ ID NO: 2517

SEQ ID NO: 2522 - DNA, 17 bp, Homo sapiens
ccaatccatgtttaaat

SEQ ID NO: 2523 - DNA, 17 bp, Homo sapiens
atttaaacatggattgg

SEQ ID NO: 2524 - DNA, 121 bp, Homo sapiens
cgtgccaattcaatttcttaacctatctcaaagatggagatcagtgtgagtccaatccatgtttaaatggcggcagttgcaaggatgacattaattcctatgaatgttggtgtccctttgg

SEQ ID NO: 2525 - DNA, 121 bp, Homo sapiens
ccaaagggacaccaacattcataggaattaatgtcatccttgcaactgccgccatttaaacatggattggactcacactgatctccatctttgagataggttaagaaattgaattggcacg

SEQ ID NO: 2526 - DNA, 17 bp, Homo sapiens
caatccatgtttaaatg

SEQ ID NO: 2527 - DNA, 17 bp, Homo sapiens
catttaaacatggattg

SEQ ID NO: 2528 - DNA, 121 bp, Homo sapiens; identical to SEQ ID NO: 2524

SEQ ID NO: 2529 - DNA, 121 bp, Homo sapiens; identical to SEQ ID NO: 2525

SEQ ID NO: 2530 - DNA, 17 bp, Homo sapiens
caatccatgtttaaatg

SEQ ID NO: 2531 - DNA, 17 bp, Homo sapiens
catttaaacatggattg

SEQ ID NO: 2532 - DNA, 121 bp, Homo sapiens
attcaatttcttaacctatctcaaagatggagatcagtgtgagtccaatccatgtttaaatggcggcagttgcaaggatgacattaattcctatgaatgttggtgtccctttggatttgaa

SEQ ID NO: 2533 - DNA, 121 bp, Homo sapiens
ttcaaatccaaagggacaccaacattcataggaattaatgtcatccttgcaactgccgccatttaaacatggattggactcacactgatctccatctttgagataggttaagaaattgaat

SEQ ID NO: 2534 - DNA, 17 bp, Homo sapiens
tgtttaaatggcggcag

SEQ ID NO: 2535 - DNA, 17 bp, Homo sapiens
ctgccgccatttaaaca

SEQ ID NO: 2536 - DNA, 121 bp, Homo sapiens
tcaatttcttaacctatctcaaagatggagatcagtgtgagtccaatccatgtttaaatggcggcagttgcaaggatgacattaattcctatgaatgttggtgtccctttggatttgaagg

SEQ ID NO: 2537 - DNA, 121 bp, Homo sapiens
ccttcaaatccaaagggacaccaacattcataggaattaatgtcatccttgcaactgccgccatttaaacatggattggactcacactgatctccatctttgagataggttaagaaattga

SEQ ID NO: 2538 - DNA, 17 bp, Homo sapiens
tttaaatggcggcagtt

SEQ ID NO: 2539 - DNA, 17 bp, Homo sapiens
aactgccgccatttaaa

SEQ ID NO: 2540 - DNA, 121 bp, Homo sapiens; identical to SEQ ID NO: 2536

SEQ ID NO: 2541 - DNA, 121 bp, Homo sapiens; identical to SEQ ID NO: 2537

SEQ ID NO: 2542 - DNA, 17 bp, Homo sapiens
tttaaatggcggcagtt

SEQ ID NO: 2543 - DNA, 17 bp, Homo sapiens
aactgccgccatttaaa

SEQ ID NO: 2544 - DNA, 121 bp, Homo sapiens
ttcaatttcttaacctatctcaaagatggagatcagtgtgagtccaatccatgtttaaatggcggcagttgcaaggatgacattaattcctatgaatgttggtgtccctttggatttgaag

SEQ ID NO: 2545 - DNA, 121 bp, Homo sapiens
cttcaaatccaaagggacaccaacattcataggaattaatgtcatccttgcaactgccgccatttaaacatggattggactcacactgatctccatctttgagataggttaagaaattgaa

SEQ ID NO: 2546 - DNA, 17 bp, Homo sapiens
gtttaaatggcggcagt

SEQ ID NO: 2547 - DNA, 17 bp, Homo sapiens
actgccgccatttaaac

SEQ ID NO: 2548 - DNA, 121 bp, Homo sapiens
aatttcttaacctatctcaaagatggagatcagtgtgagtccaatccatgtttaaatggcggcagttgcaaggatgacattaattcctatgaatgttggtgtccctttggatttgaaggaa

SEQ ID NO: 2549 - DNA, 121 bp, Homo sapiens
ttccttcaaatccaaagggacaccaacattcataggaattaatgtcatccttgcaactgccgccatttaaacatggattggactcacactgatctccatctttgagataggttaagaaatt

SEQ ID NO: 2550 - DNA, 17 bp, Homo sapiens
taaatggcggcagttgc

SEQ ID NO: 2551 - DNA, 17 bp, Homo sapiens
gcaactgccgccattta

SEQ ID NO: 2552 - DNA, 121 bp, Homo sapiens; identical to SEQ ID NO: 2548

SEQ ID NO: 2553 - DNA, 121 bp, Homo sapiens; identical to SEQ ID NO: 2549

SEQ ID NO: 2554 - DNA, 17 bp, Homo sapiens
taaatggcggcagttgc

SEQ ID NO: 2555 - DNA, 17 bp, Homo sapiens
gcaactgccgccattta

SEQ ID NO: 2556 - DNA, 121 bp, Homo sapiens
atttcttaacctatctcaaagatggagatcagtgtgagtccaatccatgtttaaatggcggcagttgcaaggatgacattaattcctatgaatgttggtgtccctttggatttgaaggaaa

SEQ ID NO: 2557 - DNA, 121 bp, Homo sapiens
tttccttcaaatccaaagggacaccaacattcataggaattaatgtcatccttgcaactgccgccatttaaacatggattggactcacactgatctccatctttgagataggttaagaaat

SEQ ID NO: 2558 - DNA, 17 bp, Homo sapiens
aaatggcggcagttgca

SEQ ID NO: 2559 - DNA, 17 bp, Homo sapiens
tgcaactgccgccattt

SEQ ID NO: 2560 - DNA, 121 bp, Homo sapiens; identical to SEQ ID NO: 2548

SEQ ID NO: 2561 - DNA, 121 bp, Homo sapiens; identical to SEQ ID NO: 2549

SEQ ID NO: 2562 - DNA, 17 bp, Homo sapiens
taaatggcggcagttgc

SEQ ID NO: 2563 - DNA, 17 bp, Homo sapiens
gcaactgccgccattta

SEQ ID NO: 2564 - DNA, 121 bp, Homo sapiens
taacctatctcaaagatggagatcagtgtgagtccaatccatgtttaaatggcggcagttgcaaggatgacattaattcctatgaatgttggtgtccctttggatttgaaggaaagaactg

SEQ ID NO: 2565 - DNA, 121 bp, Homo sapiens
cagttctttccttcaaatccaaagggacaccaacattcataggaattaatgtcatccttgcaactgccgccatttaaacatggattggactcacactgatctccatctttgagataggtta

SEQ ID NO: 2566 - DNA, 17 bp, Homo sapiens
cggcagttgcaaggatg

SEQ ID NO: 2567 - DNA, 17 bp, Homo sapiens
catccttgcaactgccg

SEQ ID NO: 2568 - DNA, 121 bp, Homo sapiens; identical to SEQ ID NO: 2564

SEQ ID NO: 2569 - DNA, 121 bp, Homo sapiens; identical to SEQ ID NO: 2565

SEQ ID NO: 2570 - DNA, 17 bp, Homo sapiens
cggcagttgcaaggatg

SEQ ID NO: 2571 - DNA, 17 bp, Homo sapiens
catccttgcaactgccg

SEQ ID NO: 2572 - DNA, 121 bp, Homo sapiens
aacctatctcaaagatggagatcagtgtgagtccaatccatgtttaaatggcggcagttgcaaggatgacattaattcctatgaatgttggtgtccctttggatttgaaggaaagaactgt

SEQ ID NO: 2573 - DNA, 121 bp, Homo sapiens
acagttctttccttcaaatccaaagggacaccaacattcataggaattaatgtcatccttgcaactgccgccatttaaacatggattggactcacactgatctccatctttgagataggtt

SEQ ID NO: 2574 - DNA, 17 bp, Homo sapiens
ggcagttgcaaggatga

SEQ ID NO: 2575 - DNA, 17 bp, Homo sapiens
tcatccttgcaactgcc

SEQ ID NO: 2576 - DNA, 121 bp, Homo sapiens
tctcaaagatggagatcagtgtgagtccaatccatgtttaaatggcggcagttgcaaggatgacattaattcctatgaatgttggtgtccctttggatttgaaggaaagaactgtgaatta

SEQ ID NO: 2577 - DNA, 121 bp, Homo sapiens
taattcacagttctttccttcaaatccaaagggacaccaacattcataggaattaatgtcatccttgcaactgccgccatttaaacatggattggactcacactgatctccatctttgaga

SEQ ID NO: 2578 - DNA, 17 bp, Homo sapiens
tgcaaggatgacattaa

SEQ ID NO: 2579 - DNA, 17 bp, Homo sapiens
ttaatgtcatccttgca

SEQ ID NO: 2580 - DNA, 121 bp, Homo sapiens
atctcaaagatggagatcagtgtgagtccaatccatgtttaaatggcggcagttgcaaggatgacattaattcctatgaatgttggtgtccctttggatttgaaggaaagaactgtgaatt

SEQ ID NO: 2581 - DNA, 121 bp, Homo sapiens
aattcacagttctttccttcaaatccaaagggacaccaacattcataggaattaatgtcatccttgcaactgccgccatttaaacatggattggactcacactgatctccatctttgagat

SEQ ID NO: 2582 - DNA, 17 bp, Homo sapiens
ttgcaaggatgacatta

SEQ ID NO: 2583 - DNA, 17 bp, Homo sapiens
taatgtcatccttgcaa

SEQ ID NO: 2584 - DNA, 121 bp, Homo sapiens
tatctcaaagatggagatcagtgtgagtccaatccatgtttaaatggcggcagttgcaaggatgacattaattcctatgaatgttggtgtccctttggatttgaaggaaagaactgtgaat

SEQ ID NO: 2585 - DNA, 121 bp, Homo sapiens
attcacagttctttccttcaaatccaaagggacaccaacattcataggaattaatgtcatccttgcaactgccgccatttaaacatggattggactcacactgatctccatctttgagata

SEQ ID NO: 2586 - DNA, 17 bp, Homo sapiens
gttgcaaggatgacatt

SEQ ID NO: 2587 - DNA, 17 bp, Homo sapiens
aatgtcatccttgcaac

SEQ ID NO: 2588 - DNA, 121 bp, Homo sapiens
aagatggagatcagtgtgagtccaatccatgtttaaatggcggcagttgcaaggatgacattaattcctatgaatgttggtgtccctttggatttgaaggaaagaactgtgaattaggtaa

SEQ ID NO: 2589 - DNA, 121 bp, Homo sapiens
ttacctaattcacagttctttccttcaaatccaaagggacaccaacattcataggaattaatgtcatccttgcaactgccgccatttaaacatggattggactcacactgatctccatctt

SEQ ID NO: 2590 - DNA, 17 bp, Homo sapiens
ggatgacattaattcct

SEQ ID NO: 2591 - DNA, 17 bp, Homo sapiens
aggaattaatgtcatcc

SEQ ID NO: 2592 - DNA, 121 bp, Homo sapiens; identical to SEQ ID NO: 2588

SEQ ID NO: 2593 - DNA, 121 bp, Homo sapiens; identical to SEQ ID NO: 2589

SEQ ID NO: 2594 - DNA, 17 bp, Homo sapiens
ggatgacattaattcct

SEQ ID NO: 2595 - DNA, 17 bp, Homo sapiens
aggaattaatgtcatcc

SEQ ID NO: 2596 - DNA, 121 bp, Homo sapiens
tggagatcagtgtgagtccaatccatgtttaaatggcggcagttgcaaggatgacattaattcctatgaatgttggtgtccctttggatttgaaggaaagaactgtgaattaggtaagtaa

SEQ ID NO: 2597 - DNA, 121 bp, Homo sapiens
ttacttacctaattcacagttctttccttcaaatccaaagggacaccaacattcataggaattaatgtcatccttgcaactgccgccatttaaacatggattggactcacactgatctcca

SEQ ID NO: 2598 - DNA, 17 bp, Homo sapiens
gacattaattcctatga

SEQ ID NO: 2599 - DNA, 17 bp, Homo sapiens
tcataggaattaatgtc

SEQ ID NO: 2600 - DNA, 121 bp, Homo sapiens
atcagtgtgagtccaatccatgtttaaatggcggcagttgcaaggatgacattaattcctatgaatgttggtgtccctttggatttgaaggaaagaactgtgaattaggtaagtaactatt

SEQ ID NO: 2601 - DNA, 121 bp, Homo sapiens
aatagttacttacctaattcacagttctttccttcaaatccaaagggacaccaacattcataggaattaatgtcatccttgcaactgccgccatttaaacatggattggactcacactgat

SEQ ID NO: 2602 - DNA, 17 bp, Homo sapiens
taattcctatgaatgtt

SEQ ID NO: 2603 - DNA, 17 bp, Homo sapiens
aacattcataggaatta

SEQ ID NO: 2604 - DNA, 121 bp, Homo sapiens
tgagtccaatccatgtttaaatggcggcagttgcaaggatgacattaattcctatgaatgttggtgtccctttggatttgaaggaaagaactgtgaattaggtaagtaactattttttgaa

SEQ ID NO: 2605 - DNA, 121 bp, Homo sapiens
ttcaaaaaatagttacttacctaattcacagttctttccttcaaatccaaagggacaccaacattcataggaattaatgtcatccttgcaactgccgccatttaaacatggattggactca

SEQ ID NO: 2606 - DNA, 17 bp, Homo sapiens
tatgaatgttggtgtcc

SEQ ID NO: 2607 - DNA, 17 bp, Homo sapiens
ggacaccaacattcata

SEQ ID NO: 2608 - DNA, 121 bp, Homo sapiens
gtgagtccaatccatgtttaaatggcggcagttgcaaggatgacattaattcctatgaatgttggtgtccctttggatttgaaggaaagaactgtgaattaggtaagtaactattttttga

SEQ ID NO: 2609 - DNA, 121 bp, Homo sapiens
tcaaaaaatagttacttacctaattcacagttctttccttcaaatccaaagggacaccaacattcataggaattaatgtcatccttgcaactgccgccatttaaacatggattggactcac

SEQ ID NO: 2610 - DNA, 17 bp, Homo sapiens
ctatgaatgttggtgtc

SEQ ID NO: 2611 - DNA, 17 bp, Homo sapiens
gacaccaacattcatag

SEQ ID NO: 2612 - DNA, 121 bp, Homo sapiens; identical to SEQ ID NO: 2608

SEQ ID NO: 2613 - DNA, 121 bp, Homo sapiens; identical to SEQ ID NO: 2609

SEQ ID NO: 2614 - DNA, 17 bp, Homo sapiens
ctatgaatgttggtgtc

SEQ ID NO: 2615 - DNA, 17 bp, Homo sapiens
gacaccaacattcatag

SEQ ID NO: 2616 - DNA, 121 bp, Homo sapiens
tgtgagtccaatccatgtttaaatggcggcagttgcaaggatgacattaattcctatgaatgttggtgtccctttggatttgaaggaaagaactgtgaattaggtaagtaactattttttg

SEQ ID NO: 2617 - DNA, 121 bp, Homo sapiens
caaaaaatagttacttacctaattcacagttctttccttcaaatccaaagggacaccaacattcataggaattaatgtcatccttgcaactgccgccatttaaacatggattggactcaca

SEQ ID NO: 2618 - DNA, 17 bp, Homo sapiens
cctatgaatgttggtgt

SEQ ID NO: 2619 - DNA, 17 bp, Homo sapiens
acaccaacattcatagg

SEQ ID NO: 2620 - DNA, 121 bp, Homo sapiens
gagtccaatccatgtttaaatggcggcagttgcaaggatgacattaattcctatgaatgttggtgtccctttggatttgaaggaaagaactgtgaattaggtaagtaactattttttgaat

SEQ ID NO: 2621 - DNA, 121 bp, Homo sapiens
attcaaaaaatagttacttacctaattcacagttctttccttcaaatccaaagggacaccaacattcataggaattaatgtcatccttgcaactgccgccatttaaacatggattggactc

SEQ ID NO: 2622 - DNA, 17 bp, Homo sapiens
atgaatgttggtgtccc

SEQ ID NO: 2623 - DNA, 17 bp, Homo sapiens
gggacaccaacattcat

SEQ ID NO: 2624 - DNA, 121 bp, Homo sapiens
gtccaatccatgtttaaatggcggcagttgcaaggatgacattaattcctatgaatgttggtgtccctttggatttgaaggaaagaactgtgaattaggtaagtaactattttttgaatac

SEQ ID NO: 2625 - DNA, 121 bp, Homo sapiens
gtattcaaaaaatagttacttacctaattcacagttctttccttcaaatccaaagggacaccaacattcataggaattaatgtcatccttgcaactgccgccatttaaacatggattggac

SEQ ID NO: 2626 - DNA, 17 bp, Homo sapiens
gaatgttggtgtccctt

SEQ ID NO: 2627 - DNA, 17 bp, Homo sapiens
aagggacaccaacattc

SEQ ID NO: 2628 - DNA, 121 bp, Homo sapiens
ccaatccatgtttaaatggcggcagttgcaaggatgacattaattcctatgaatgttggtgtccctttggatttgaaggaaagaactgtgaattaggtaagtaactattttttgaatactc

SEQ ID NO: 2629 - DNA, 121 bp, Homo sapiens
gagtattcaaaaaatagttacttacctaattcacagttctttccttcaaatccaaagggacaccaacattcataggaattaatgtcatccttgcaactgccgccatttaaacatggattgg

SEQ ID NO: 2630 - DNA, 17 bp, Homo sapiens
atgttggtgtccctttg

SEQ ID NO: 2631 - DNA, 17 bp, Homo sapiens
caaagggacaccaacat

SEQ ID NO: 2632 - DNA, 121 bp, Homo sapiens
tccaatccatgtttaaatggcggcagttgcaaggatgacattaattcctatgaatgttggtgtccctttggatttgaaggaaagaactgtgaattaggtaagtaactattttttgaatact

SEQ ID NO: 2633 - DNA, 121 bp, Homo sapiens
agtattcaaaaaatagttacttacctaattcacagttctttccttcaaatccaaagggacaccaacattcataggaattaatgtcatccttgcaactgccgccatttaaacatggattgga

SEQ ID NO: 2634 - DNA, 17 bp, Homo sapiens
aatgttggtgtcccttt

SEQ ID NO: 2635 - DNA, 17 bp, Homo sapiens
aaagggacaccaacatt

SEQ ID NO: 2636 - DNA, 121 bp, Homo sapiens; identical to SEQ ID NO: 2628

SEQ ID NO: 2637 - DNA, 121 bp, Homo sapiens; identical to SEQ ID NO: 2629

SEQ ID NO: 2638 - DNA, 17 bp, Homo sapiens
atgttggtgtccctttg

SEQ ID NO: 2639 - DNA, 17 bp, Homo sapiens
caaagggacaccaacat

SEQ ID NO: 2640 - DNA, 121 bp, Homo sapiens
caatccatgtttaaatggcggcagttgcaaggatgacattaattcctatgaatgttggtgtccctttggatttgaaggaaagaactgtgaattaggtaagtaactattttttgaatactca

SEQ ID NO: 2641 - DNA, 121 bp, Homo sapiens
tgagtattcaaaaaatagttacttacctaattcacagttctttccttcaaatccaaagggacaccaacattcataggaattaatgtcatccttgcaactgccgccatttaaacatggattg

SEQ ID NO: 2642 - DNA, 17 bp, Homo sapiens
tgttggtgtccctttgg

SEQ ID NO: 2643 - DNA, 17 bp, Homo sapiens
ccaaagggacaccaaca

SEQ ID NO: 2644 - DNA, 121 bp, Homo sapiens
gtttaaatggcggcagttgcaaggatgacattaattcctatgaatgttggtgtccctttggatttgaaggaaagaactgtgaattaggtaagtaactattttttgaatactcatggttcaa

SEQ ID NO: 2645 - DNA, 121 bp, Homo sapiens
ttgaaccatgagtattcaaaaaatagttacttacctaattcacagttctttccttcaaatccaaagggacaccaacattcataggaattaatgtcatccttgcaactgccgccatttaaac

SEQ ID NO: 2646 - DNA, 17 bp, Homo sapiens
tccctttggatttgaag

SEQ ID NO: 2647 - DNA, 17 bp, Homo sapiens
cttcaaatccaaaggga

SEQ ID NO: 2648 - DNA, 121 bp, Homo sapiens
tgtttaaatggcggcagttgcaaggatgacattaattcctatgaatgttggtgtccctttggatttgaaggaaagaactgtgaattaggtaagtaactattttttgaatactcatggttca

SEQ ID NO: 2649 - DNA, 121 bp, Homo sapiens
tgaaccatgagtattcaaaaaatagttacttacctaattcacagttctttccttcaaatccaaagggacaccaacattcataggaattaatgtcatccttgcaactgccgccatttaaaca

SEQ ID NO: 2650 - DNA, 17 bp, Homo sapiens
gtccctttggatttgaa

SEQ ID NO: 2651 - DNA, 17 bp, Homo sapiens
ttcaaatccaaagggac

SEQ ID NO: 2652 - DNA, 121 bp, Homo sapiens
taaatggcggcagttgcaaggatgacattaattcctatgaatgttggtgtccctttggatttgaaggaaagaactgtgaattaggtaagtaactattttttgaatactcatggttcaaagt

SEQ ID NO: 2653 - DNA, 121 bp, Homo sapiens
actttgaaccatgagtattcaaaaaatagttacttacctaattcacagttctttccttcaaatccaaagggacaccaacattcataggaattaatgtcatccttgcaactgccgccattta

SEQ ID NO: 2654 - DNA, 17 bp, Homo sapiens
ctttggatttgaaggaa

SEQ ID NO: 2655 - DNA, 17 bp, Homo sapiens
ttccttcaaatccaaag

SEQ ID NO: 2656 - DNA, 121 bp, Homo sapiens; identical to SEQ ID NO: 2652

SEQ ID NO: 2657 - DNA, 121 bp, Homo sapiens; identical to SEQ ID NO: 2653

SEQ ID NO: 2658 - DNA, 17 bp, Homo sapiens
ctttggatttgaaggaa

SEQ ID NO: 2659 - DNA, 17 bp, Homo sapiens
ttccttcaaatccaaag

SEQ ID NO: 2660 - DNA, 121 bp, Homo sapiens; identical to SEQ ID NO: 2652

SEQ ID NO: 2661 - DNA, 121 bp, Homo sapiens; identical to SEQ ID NO: 2653

SEQ ID NO: 2662 - DNA, 17 bp, Homo sapiens
ctttggatttgaaggaa

SEQ ID NO: 2663 - DNA, 17 bp, Homo sapiens
ttccttcaaatccaaag

SEQ ID NO: 2664 - DNA, 121 bp, Homo sapiens
aatggcggcagttgcaaggatgacattaattcctatgaatgttggtgtccctttggatttgaaggaaagaactgtgaattaggtaagtaactattttttgaatactcatggttcaaagttt

SEQ ID NO: 2665 - DNA, 121 bp, Homo sapiens
aaactttgaaccatgagtattcaaaaaatagttacttacctaattcacagttctttccttcaaatccaaagggacaccaacattcataggaattaatgtcatccttgcaactgccgccatt

SEQ ID NO: 2666 - DNA, 17 bp, Homo sapiens
ttggatttgaaggaaag

SEQ ID NO: 2667 - DNA, 17 bp, Homo sapiens
ctttccttcaaatccaa

SEQ ID NO: 2668 - DNA, 121 bp, Homo sapiens
gcggcagttgcaaggatgacattaattcctatgaatgttggtgtccctttggatttgaaggaaagaactgtgaattaggtaagtaactattttttgaatactcatggttcaaagtttccct

SEQ ID NO: 2669 - DNA, 121 bp, Homo sapiens
agggaaactttgaaccatgagtattcaaaaaatagttacttacctaattcacagttctttccttcaaatccaaagggacaccaacattcataggaattaatgtcatccttgcaactgccgc

SEQ ID NO: 2670 - DNA, 17 bp, Homo sapiens
atttgaaggaaagaact

SEQ ID NO: 2671 - DNA, 17 bp, Homo sapiens
agttctttccttcaaat

SEQ ID NO: 2672 - DNA, 121 bp, Homo sapiens
ggcggcagttgcaaggatgacattaattcctatgaatgttggtgtccctttggatttgaaggaaagaactgtgaattaggtaagtaactattttttgaatactcatggttcaaagtttccc

SEQ ID NO: 2673 - DNA, 121 bp, Homo sapiens
gggaaactttgaaccatgagtattcaaaaaatagttacttacctaattcacagttctttccttcaaatccaaagggacaccaacattcataggaattaatgtcatccttgcaactgccgcc

SEQ ID NO: 2674 - DNA, 17 bp, Homo sapiens
gatttgaaggaaagaac

SEQ ID NO: 2675 - DNA, 17 bp, Homo sapiens
gttctttccttcaaatc

SEQ ID NO: 2676 - DNA, 121 bp, Homo sapiens; identical to SEQ ID NO: 2668

SEQ ID NO: 2677 - DNA, 121 bp, Homo sapiens; identical to SEQ ID NO: 2669

SEQ ID NO: 2678 - DNA, 17 bp, Homo sapiens
atttgaaggaaagaact

SEQ ID NO: 2679 - DNA, 17 bp, Homo sapiens
agttctttccttcaaat

SEQ ID NO: 2680 - DNA, 121 bp, Homo sapiens
ttagaaatgcatgttaaatgatgctgttactgtctattttgcttcttttagatgtaacatgtaacattaagaatggcagatgcgagcagttttgtaaaaatagtgctgataacaaggtggt

SEQ ID NO: 2681 - DNA, 121 bp, Homo sapiens
accaccttgttatcagcactatttttacaaaactgctcgcatctgccattcttaatgttacatgttacatctaaaagaagcaaaatagacagtaacagcatcatttaacatgcatttctaa

SEQ ID NO: 2682 - DNA, 17 bp, Homo sapiens
tgtaacatgtaacatta

SEQ ID NO: 2683 - DNA, 17 bp, Homo sapiens
taatgttacatgttaca

SEQ ID NO: 2684 - DNA, 121 bp, Homo sapiens; identical to SEQ ID NO: 2680

SEQ ID NO: 2685 - DNA, 121 bp, Homo sapiens; identical to SEQ ID NO: 2681

SEQ ID NO: 2686 - DNA, 17 bp, Homo sapiens
tgtaacatgtaacatta

SEQ ID NO: 2687 - DNA, 17 bp, Homo sapiens
taatgttacatgttaca

SEQ ID NO: 2688 - DNA, 121 bp, Homo sapiens
tttagaaatgcatgttaaatgatgctgttactgtctattttgcttcttttagatgtaacatgtaacattaagaatggcagatgcgagcagttttgtaaaaatagtgctgataacaaggtgg

SEQ ID NO: 2689 - DNA, 121 bp, Homo sapiens
ccaccttgttatcagcactatttttacaaaactgctcgcatctgccattcttaatgttacatgttacatctaaaagaagcaaaatagacagtaacagcatcatttaacatgcatttctaaa

SEQ ID NO: 2690 - DNA, 17 bp, Homo sapiens
atgtaacatgtaacatt

SEQ ID NO: 2691 - DNA, 17 bp, Homo sapiens
aatgttacatgttacat

SEQ ID NO: 2692 - DNA, 121 bp, Homo sapiens; identical to SEQ ID NO: 2680

SEQ ID NO: 2693 - DNA, 121 bp, Homo sapiens; identical to SEQ ID NO: 2681

SEQ ID NO: 2694 - DNA, 17 bp, Homo sapiens
tgtaacatgtaacatta

SEQ ID NO: 2695 - DNA, 17 bp, Homo sapiens
taatgttacatgttaca

SEQ ID NO: 2696 - DNA, 121 bp, Homo sapiens
atgcatgttaaatgatgctgttactgtctattttgcttcttttagatgtaacatgtaacattaagaatggcagatgcgagcagttttgtaaaaatagtgctgataacaaggtggtttgctc

SEQ ID NO: 2697 - DNA, 121 bp, Homo sapiens
gagcaaaccaccttgttatcagcactatttttacaaaactgctcgcatctgccattcttaatgttacatgttacatctaaaagaagcaaaatagacagtaacagcatcatttaacatgcat

SEQ ID NO: 2698 - DNA, 17 bp, Homo sapiens
atgtaacattaagaatg

SEQ ID NO: 2699 - DNA, 17 bp, Homo sapiens
cattcttaatgttacat

SEQ ID NO: 2700 - DNA, 121 bp, Homo sapiens
tgttaaatgatgctgttactgtctattttgcttcttttagatgtaacatgtaacattaagaatggcagatgcgagcagttttgtaaaaatagtgctgataacaaggtggtttgctcctgta

SEQ ID NO: 2701 - DNA, 121 bp, Homo sapiens
tacaggagcaaaccaccttgttatcagcactatttttacaaaactgctcgcatctgccattcttaatgttacatgttacatctaaaagaagcaaaatagacagtaacagcatcatttaaca

SEQ ID NO: 2702 - DNA, 17 bp, Homo sapiens
acattaagaatggcaga

SEQ ID NO: 2703 - DNA, 17 bp, Homo sapiens
tctgccattcttaatgt

SEQ ID NO: 2704 - DNA, 121 bp, Homo sapiens
ttaaatgatgctgttactgtctattttgcttcttttagatgtaacatgtaacattaagaatggcagatgcgagcagttttgtaaaaatagtgctgataacaaggtggtttgctcctgtact

SEQ ID NO: 2705 - DNA, 121 bp, Homo sapiens
agtacaggagcaaaccaccttgttatcagcactatttttacaaaactgctcgcatctgccattcttaatgttacatgttacatctaaaagaagcaaaatagacagtaacagcatcatttaa

SEQ ID NO: 2706 - DNA, 17 bp, Homo sapiens
attaagaatggcagatg

SEQ ID NO: 2707 - DNA, 17 bp, Homo sapiens
catctgccattcttaat

SEQ ID NO: 2708 - DNA, 121 bp, Homo sapiens
aaatgatgctgttactgtctattttgcttcttttagatgtaacatgtaacattaagaatggcagatgcgagcagttttgtaaaaatagtgctgataacaaggtggtttgctcctgtactga

SEQ ID NO: 2709 - DNA, 121 bp, Homo sapiens
tcagtacaggagcaaaccaccttgttatcagcactatttttacaaaactgctcgcatctgccattcttaatgttacatgttacatctaaaagaagcaaaatagacagtaacagcatcattt

SEQ ID NO: 2710 - DNA, 17 bp, Homo sapiens
taagaatggcagatgcg

SEQ ID NO: 2711 - DNA, 17 bp, Homo sapiens
cgcatctgccattctta

SEQ ID NO: 2712 - DNA, 121 bp, Homo sapiens
taaatgatgctgttactgtctattttgcttcttttagatgtaacatgtaacattaagaatggcagatgcgagcagttttgtaaaaatagtgctgataacaaggtggtttgctcctgtactg

SEQ ID NO: 2713 - DNA, 121 bp, Homo sapiens
cagtacaggagcaaaccaccttgttatcagcactatttttacaaaactgctcgcatctgccattcttaatgttacatgttacatctaaaagaagcaaaatagacagtaacagcatcattta

SEQ ID NO: 2714 - DNA, 17 bp, Homo sapiens
ttaagaatggcagatgc

SEQ ID NO: 2715 - DNA, 17 bp, Homo sapiens
gcatctgccattcttaa

SEQ ID NO: 2716 - DNA, 121 bp, Homo sapiens
gatgctgttactgtctattttgcttcttttagatgtaacatgtaacattaagaatggcagatgcgagcagttttgtaaaaatagtgctgataacaaggtggtttgctcctgtactgaggga

SEQ ID NO: 2717 - DNA, 121 bp, Homo sapiens
tccctcagtacaggagcaaaccaccttgttatcagcactatttttacaaaactgctcgcatctgccattcttaatgttacatgttacatctaaaagaagcaaaatagacagtaacagcatc

SEQ ID NO: 2718 - DNA, 17 bp, Homo sapiens
aatggcagatgcgagca

SEQ ID NO: 2719 - DNA, 17 bp, Homo sapiens
tgctcgcatctgccatt

SEQ ID NO: 2720 - DNA, 121 bp, Homo sapiens
tgctgttactgtctattttgcttcttttagatgtaacatgtaacattaagaatggcagatgcgagcagttttgtaaaaatagtgctgataacaaggtggtttgctcctgtactgagggata

SEQ ID NO: 2721 - DNA, 121 bp, Homo sapiens
tatccctcagtacaggagcaaaccaccttgttatcagcactatttttacaaaactgctcgcatctgccattcttaatgttacatgttacatctaaaagaagcaaaatagacagtaacagca

SEQ ID NO: 2722 - DNA, 17 bp, Homo sapiens
tggcagatgcgagcagt

SEQ ID NO: 2723 - DNA, 17 bp, Homo sapiens
actgctcgcatctgcca

SEQ ID NO: 2724 - DNA, 121 bp, Homo sapiens
gctgttactgtctattttgcttcttttagatgtaacatgtaacattaagaatggcagatgcgagcagttttgtaaaaatagtgctgataacaaggtggtttgctcctgtactgagggatat

SEQ ID NO: 2725 - DNA, 121 bp, Homo sapiens
atatccctcagtacaggagcaaaccaccttgttatcagcactatttttacaaaactgctcgcatctgccattcttaatgttacatgttacatctaaaagaagcaaaatagacagtaacagc

SEQ ID NO: 2726 - DNA, 17 bp, Homo sapiens
ggcagatgcgagcagtt

SEQ ID NO: 2727 - DNA, 17 bp, Homo sapiens
aactgctcgcatctgcc

SEQ ID NO: 2728 - DNA, 121 bp, Homo sapiens; identical to SEQ ID NO: 2724

SEQ ID NO: 2729 - DNA, 121 bp, Homo sapiens; identical to SEQ ID NO: 2725

SEQ ID NO: 2730 - DNA, 17 bp, Homo sapiens
ggcagatgcgagcagtt

SEQ ID NO: 2731 - DNA, 17 bp, Homo sapiens
aactgctcgcatctgcc

SEQ ID NO: 2732 - DNA, 121 bp, Homo sapiens
tactgtctattttgcttcttttagatgtaacatgtaacattaagaatggcagatgcgagcagttttgtaaaaatagtgctgataacaaggtggtttgctcctgtactgagggatatcgact

SEQ ID NO: 2733 - DNA, 121 bp, Homo sapiens
agtcgatatccctcagtacaggagcaaaccaccttgttatcagcactatttttacaaaactgctcgcatctgccattcttaatgttacatgttacatctaaaagaagcaaaatagacagta

SEQ ID NO: 2734 - DNA, 17 bp, Homo sapiens
atgcgagcagttttgta

SEQ ID NO: 2735 - DNA, 17 bp, Homo sapiens
tacaaaactgctcgcat

SEQ ID NO: 2736 - DNA, 121 bp, Homo sapiens
ttactgtctattttgcttcttttagatgtaacatgtaacattaagaatggcagatgcgagcagttttgtaaaaatagtgctgataacaaggtggtttgctcctgtactgagggatatcgac

SEQ ID NO: 2737 - DNA, 121 bp, Homo sapiens
gtcgatatccctcagtacaggagcaaaccaccttgttatcagcactatttttacaaaactgctcgcatctgccattcttaatgttacatgttacatctaaaagaagcaaaatagacagtaa

SEQ ID NO: 2738 - DNA, 17 bp, Homo sapiens
gatgcgagcagttttgt

SEQ ID NO: 2739 - DNA, 17 bp, Homo sapiens
acaaaactgctcgcatc

SEQ ID NO: 2740 - DNA, 121 bp, Homo sapiens
tctattttgcttcttttagatgtaacatgtaacattaagaatggcagatgcgagcagttttgtaaaaatagtgctgataacaaggtggtttgctcctgtactgagggatatcgacttgcag

SEQ ID NO: 2741 - DNA, 121 bp, Homo sapiens
ctgcaagtcgatatccctcagtacaggagcaaaccaccttgttatcagcactatttttacaaaactgctcgcatctgccattcttaatgttacatgttacatctaaaagaagcaaaataga

SEQ ID NO: 2742 - DNA, 17 bp, Homo sapiens
agcagttttgtaaaaat

SEQ ID NO: 2743 - DNA, 17 bp, Homo sapiens
atttttacaaaactgct

SEQ ID NO: 2744 - DNA, 121 bp, Homo sapiens
ctattttgcttcttttagatgtaacatgtaacattaagaatggcagatgcgagcagttttgtaaaaatagtgctgataacaaggtggtttgctcctgtactgagggatatcgacttgcaga

SEQ ID NO: 2745 - DNA, 121 bp, Homo sapiens
tctgcaagtcgatatccctcagtacaggagcaaaccaccttgttatcagcactatttttacaaaactgctcgcatctgccattcttaatgttacatgttacatctaaaagaagcaaaatag

SEQ ID NO: 2746 - DNA, 17 bp, Homo sapiens
gcagttttgtaaaaata

SEQ ID NO: 2747 - DNA, 17 bp, Homo sapiens
tatttttacaaaactgc

SEQ ID NO: 2748 - DNA, 121 bp, Homo sapiens
ttttttgctaaaactaaagaattattcttttacatttcagtttttcttgatcatgaaaacgccaacaaaattctgaatcggccaaagaggtataattcaggtaaattggaagagtttgttc

SEQ ID NO: 2749 - DNA, 121 bp, Homo sapiens
gaacaaactcttccaatttacctgaattatacctctttggccgattcagaattttgttggcgttttcatgatcaagaaaaactgaaatgtaaaagaataattctttagttttagcaaaaaa

SEQ ID NO: 2750 - DNA, 17 bp, Homo sapiens
atgaaaacgccaacaaa

SEQ ID NO: 2751 - DNA, 17 bp, Homo sapiens
tttgttggcgttttcat

SEQ ID NO: 2752 - DNA, 121 bp, Homo sapiens
tttttgctaaaactaaagaattattcttttacatttcagtttttcttgatcatgaaaacgccaacaaaattctgaatcggccaaagaggtataattcaggtaaattggaagagtttgttca

SEQ ID NO: 2753 - DNA, 121 bp, Homo sapiens
tgaacaaactcttccaatttacctgaattatacctctttggccgattcagaattttgttggcgttttcatgatcaagaaaaactgaaatgtaaaagaataattctttagttttagcaaaaa

SEQ ID NO: 2754 - DNA, 17 bp, Homo sapiens
tgaaaacgccaacaaaa

SEQ ID NO: 2755 - DNA, 17 bp, Homo sapiens
ttttgttggcgttttca

SEQ ID NO: 2756 - DNA, 121 bp, Homo sapiens
tgcagcgcgtgaacatgatcatggcagaatcaccaggcctcatcaccatctgccttttaggatatctactcagtgctgaatgtacaggtttgtttccttttttaaaatacattgagtatgc

SEQ ID NO: 2757 - DNA, 121 bp, Homo sapiens
gcatactcaatgtattttaaaaaaggaaacaaacctgtacattcagcactgagtagatatcctaaaaggcagatggtgatgaggcctggtgattctgccatgatcatgttcacgcgctgca

SEQ ID NO: 2758 - DNA, 17 bp, Homo sapiens
ccttttaggatatctac

SEQ ID NO: 2759 - DNA, 17 bp, Homo sapiens
gtagatatcctaaaagg

SEQ ID NO: 2760 - DNA, 121 bp, Homo sapiens
ttatgcagcgcgtgaacatgatcatggcagaatcaccaggcctcatcaccatctgccttttaggatatctactcagtgctgaatgtacaggtttgtttccttttttaaaatacattgagta

SEQ ID NO: 2761 - DNA, 121 bp, Homo sapiens
tactcaatgtattttaaaaaaggaaacaaacctgtacattcagcactgagtagatatcctaaaaggcagatggtgatgaggcctggtgattctgccatgatcatgttcacgcgctgcataa

SEQ ID NO: 2762 - DNA, 17 bp, Homo sapiens
ctgccttttaggatatc

SEQ ID NO: 2763 - DNA, 17 bp, Homo sapiens
gatatcctaaaaggcag

SEQ ID NO: 2764 - DNA, 121 bp, Homo sapiens
tagcaaaggttatgcagcgcgtgaacatgatcatggcagaatcaccaggcctcatcaccatctgccttttaggatatctactcagtgctgaatgtacaggtttgtttccttttttaaaata

SEQ ID NO: 2765 - DNA, 121 bp, Homo sapiens
tattttaaaaaaggaaacaaacctgtacattcagcactgagtagatatcctaaaaggcagatggtgatgaggcctggtgattctgccatgatcatgttcacgcgctgcataacctttgcta

SEQ ID NO: 2766 - DNA, 17 bp, Homo sapiens
catcaccatctgccttt

SEQ ID NO: 2767 - DNA, 17 bp, Homo sapiens
aaaggcagatggtgatg

SEQ ID NO: 2768 - DNA, 121 bp, Homo sapiens
actaatcgaccttaccactttcacaatctgctagcaaaggttatgcagcgcgtgaacatgatcatggcagaatcaccaggcctcatcaccatctgccttttaggatatctactcagtgctg

SEQ ID NO: 2769 - DNA, 121 bp, Homo sapiens
cagcactgagtagatatcctaaaaggcagatggtgatgaggcctggtgattctgccatgatcatgttcacgcgctgcataacctttgctagcagattgtgaaagtggtaaggtcgattagt

SEQ ID NO: 2770 - DNA, 17 bp, Homo sapiens
tgaacatgatcatggca

SEQ ID NO: 2771 - DNA, 17 bp, Homo sapiens
tgccatgatcatgttca

SEQ ID NO: 2772 - DNA, 121 bp, Homo sapiens
actttggtacaactaatcgaccttaccactttcacaatctgctagcaaaggttatgcagcgcgtgaacatgatcatggcagaatcaccaggcctcatcaccatctgccttttaggatatct

SEQ ID NO: 2773 - DNA, 121 bp, Homo sapiens
agatatcctaaaaggcagatggtgatgaggcctggtgattctgccatgatcatgttcacgcgctgcataacctttgctagcagattgtgaaagtggtaaggtcgattagttgtaccaaagt

SEQ ID NO: 2774 - DNA, 17 bp, Homo sapiens
tatgcagcgcgtgaaca

SEQ ID NO: 2775 - DNA, 17 bp, Homo sapiens
tgttcacgcgctgcata

SEQ ID NO: 2776 - DNA, 121 bp, Homo sapiens
ccctggcgcgctcgcggcccggcactcttctggtccccacagactcagagagaacccaccatggtgctgtctcctgccgacaagaccaacgtcaaggccgcctggggtaaggtcggcgcgc

SEQ ID NO: 2777 - DNA, 121 bp, Homo sapiens
gcgcgccgaccttaccccaggcggccttgacgttggtcttgtcggcaggagacagcaccatggtgggttctctctgagtctgtggggaccagaagagtgccgggccgcgagcgcgccaggg

SEQ ID NO: 2778 - DNA, 17 bp, Homo sapiens
aacccaccatggtgctg

SEQ ID NO: 2779 - DNA, 17 bp, Homo sapiens
cagcaccatggtgggtt

SEQ ID NO: 2780 - DNA, 121 bp, Homo sapiens
cacagactcagagagaacccaccatggtgctgtctcctgccgacaagaccaacgtcaaggccgcctggggtaaggtcggcgcgcacgctggcgagtatggtgcggaggccctggagaggtg

SEQ ID NO: 2781 - DNA, 121 bp, Homo sapiens
cacctctccagggcctccgcaccatactcgccagcgtgcgcgccgaccttaccccaggcggccttgacgttggtcttgtcggcaggagacagcaccatggtgggttctctctgagtctgtg

SEQ ID NO: 2782 - DNA, 17 bp, Homo sapiens
cgtcaaggccgcctggg

SEQ ID NO: 2783 - DNA, 17 bp, Homo sapiens
cccaggcggccttgacg

SEQ ID NO: 2784 - DNA, 121 bp, Homo sapiens
agagagaacccaccatggtgctgtctcctgccgacaagaccaacgtcaaggccgcctggggtaaggtcggcgcgcacgctggcgagtatggtgcggaggccctggagaggtgaggctccct

SEQ ID NO: 2785 - DNA, 121 bp, Homo sapiens
agggagcctcacctctccagggcctccgcaccatactcgccagcgtgcgcgccgaccttaccccaggcggccttgacgttggtcttgtcggcaggagacagcaccatggtgggttctctct

SEQ ID NO: 2786 - DNA, 17 bp, Homo sapiens
cgcctggggtaaggtcg

SEQ ID NO: 2787 - DNA, 17 bp, Homo sapiens
cgaccttaccccaggcg

SEQ ID NO: 2788 - DNA, 121 bp, Homo sapiens
ctgccgacaagaccaacgtcaaggccgcctggggtaaggtcggcgcgcacgctggcgagtatggtgcggaggccctggagaggtgaggctccctcccctgctccgacccgggctcctcgcc

SEQ ID NO: 2789 - DNA, 121 bp, Homo sapiens
ggcgaggagcccgggtcggagcaggggagggagcctcacctctccagggcctccgcaccatactcgccagcgtgcgcgccgaccttaccccaggcggccttgacgttggtcttgtcggcag

SEQ ID NO: 2790 - DNA, 17 bp, Homo sapiens
tggcgagtatggtgcgg

SEQ ID NO: 2791 - DNA, 17 bp, Homo sapiens
ccgcaccatactcgcca

SEQ ID NO: 2792 - DNA, 121 bp, Homo sapiens
gaccaacgtcaaggccgcctggggtaaggtcggcgcgcacgctggcgagtatggtgcggaggccctggagaggtgaggctccctcccctgctccgacccgggctcctcgcccgcccggacc

SEQ ID NO: 2793 - DNA, 121 bp, Homo sapiens
ggtccgggcgggcgaggagcccgggtcggagcaggggagggagcctcacctctccagggcctccgcaccatactcgccagcgtgcgcgccgaccttaccccaggcggccttgacgttggtc

SEQ ID NO: 2794 - DNA, 17 bp, Homo sapiens
ggtgcggaggccctgga

SEQ ID NO: 2795 - DNA, 17 bp, Homo sapiens
tccagggcctccgcacc

SEQ ID NO: 2796 - DNA, 121 bp, Homo sapiens
gagccacggctctgcccaggttaagggccacggcaagaaggtggccgacgcgctgaccaacgccgtggcgcacgtggacgacatgcccaacgcgctgtccgccctgagcgacctgcacgcg

SEQ ID NO: 2797 - DNA, 121 bp, Homo sapiens
cgcgtgcaggtcgctcagggcggacagcgcgttgggcatgtcgtccacgtgcgccacggcgttggtcagcgcgtcggccaccttcttgccgtggcccttaacctgggcagagccgtggctc

SEQ ID NO: 2798 - DNA, 17 bp, Homo sapiens
ctgaccaacgccgtggc

SEQ ID NO: 2799 - DNA, 17 bp, Homo sapiens
gccacggcgttggtcag

SEQ ID NO: 2800 - DNA, 121 bp, Homo sapiens
aggttaagggccacggcaagaaggtggccgacgcgctgaccaacgccgtggcgcacgtggacgacatgcccaacgcgctgtccgccctgagcgacctgcacgcgcacaagcttcgggtgga

SEQ ID NO: 2801 - DNA, 121 bp, Homo sapiens
tccacccgaagcttgtgcgcgtgcaggtcgctcagggcggacagcgcgttgggcatgtcgtccacgtgcgccacggcgttggtcagcgcgtcggccaccttcttgccgtggcccttaacct

SEQ ID NO: 2802 - DNA, 17 bp, Homo sapiens
gcacgtggacgacatgc

SEQ ID NO: 2803 - DNA, 17 bp, Homo sapiens
gcatgtcgtccacgtgc

SEQ ID NO: 2804 - DNA, 121 bp, Homo sapiens
caggttaagggccacggcaagaaggtggccgacgcgctgaccaacgccgtggcgcacgtggacgacatgcccaacgcgctgtccgccctgagcgacctgcacgcgcacaagcttcgggtgg

SEQ ID NO: 2805 - DNA, 121 bp, Homo sapiens
ccacccgaagcttgtgcgcgtgcaggtcgctcagggcggacagcgcgttgggcatgtcgtccacgtgcgccacggcgttggtcagcgcgtcggccaccttcttgccgtggcccttaacctg

SEQ ID NO: 2806 - DNA, 17 bp, Homo sapiens
cgcacgtggacgacatg

SEQ ID NO: 2807 - DNA, 17 bp, Homo sapiens
catgtcgtccacgtgcg

SEQ ID NO: 2808 - DNA, 121 bp, Homo sapiens
cacggcaagaaggtggccgacgcgctgaccaacgccgtggcgcacgtggacgacatgcccaacgcgctgtccgccctgagcgacctgcacgcgcacaagcttcgggtggacccggtcaact

SEQ ID NO: 2809 - DNA, 121 bp, Homo sapiens
agttgaccgggtccacccgaagcttgtgcgcgtgcaggtcgctcagggcggacagcgcgttgggcatgtcgtccacgtgcgccacggcgttggtcagcgcgtcggccaccttcttgccgtg

SEQ ID NO: 2810 - DNA, 17 bp, Homo sapiens
acatgcccaacgcgctg

SEQ ID NO: 2811 - DNA, 17 bp, Homo sapiens
cagcgcgttgggcatgt

SEQ ID NO: 2812 - DNA, 121 bp, Homo sapiens
accaacgccgtggcgcacgtggacgacatgcccaacgcgctgtccgccctgagcgacctgcacgcgcacaagcttcgggtggacccggtcaacttcaaggtgagcggcgggccgggagcga

SEQ ID NO: 2813 - DNA, 121 bp, Homo sapiens
tcgctcccggcccgccgctcaccttgaagttgaccgggtccacccgaagcttgtgcgcgtgcaggtcgctcagggcggacagcgcgttgggcatgtcgtccacgtgcgccacggcgttggt

SEQ ID NO: 2814 - DNA, 17 bp, Homo sapiens
gcgacctgcacgcgcac

SEQ ID NO: 2815 - DNA, 17 bp, Homo sapiens
gtgcgcgtgcaggtcgc

SEQ ID NO: 2816 - DNA, 121 bp, Homo sapiens
ggcgcacgtggacgacatgcccaacgcgctgtccgccctgagcgacctgcacgcgcacaagcttcgggtggacccggtcaacttcaaggtgagcggcgggccgggagcgatctgggtcgag

SEQ ID NO: 2817 - DNA, 121 bp, Homo sapiens
ctcgacccagatcgctcccggcccgccgctcaccttgaagttgaccgggtccacccgaagcttgtgcgcgtgcaggtcgctcagggcggacagcgcgttgggcatgtcgtccacgtgcgcc

SEQ ID NO: 2818 - DNA, 17 bp, Homo sapiens
gcgcacaagcttcgggt

SEQ ID NO: 2819 - DNA, 17 bp, Homo sapiens
acccgaagcttgtgcgc

SEQ ID NO: 2820 - DNA, 121 bp, Homo sapiens
tggcgcacgtggacgacatgcccaacgcgctgtccgccctgagcgacctgcacgcgcacaagcttcgggtggacccggtcaacttcaaggtgagcggcgggccgggagcgatctgggtcga

SEQ ID NO: 2821 - DNA, 121 bp, Homo sapiens
tcgacccagatcgctcccggcccgccgctcaccttgaagttgaccgggtccacccgaagcttgtgcgcgtgcaggtcgctcagggcggacagcgcgttgggcatgtcgtccacgtgcgcca

SEQ ID NO: 2822 - DNA, 17 bp, Homo sapiens
cgcgcacaagcttcggg

SEQ ID NO: 2823 - DNA, 17 bp, Homo sapiens
cccgaagcttgtgcgcg

SEQ ID NO: 2824 - DNA, 121 bp, Homo sapiens
acgtggacgacatgcccaacgcgctgtccgccctgagcgacctgcacgcgcacaagcttcgggtggacccggtcaacttcaaggtgagcggcgggccgggagcgatctgggtcgaggggcg

SEQ ID NO: 2825 - DNA, 121 bp, Homo sapiens
cgcccctcgacccagatcgctcccggcccgccgctcaccttgaagttgaccgggtccacccgaagcttgtgcgcgtgcaggtcgctcagggcggacagcgcgttgggcatgtcgtccacgt

SEQ ID NO: 2826 - DNA, 17 bp, Homo sapiens
caagcttcgggtggacc

SEQ ID NO: 2827 - DNA, 17 bp, Homo sapiens
ggtccacccgaagcttg

SEQ ID NO: 2828 - DNA, 121 bp, Homo sapiens
acgacatgcccaacgcgctgtccgccctgagcgacctgcacgcgcacaagcttcgggtggacccggtcaacttcaaggtgagcggcgggccgggagcgatctgggtcgaggggcgagatgg

SEQ ID NO: 2829 - DNA, 121 bp, Homo sapiens
ccatctcgcccctcgacccagatcgctcccggcccgccgctcaccttgaagttgaccgggtccacccgaagcttgtgcgcgtgcaggtcgctcagggcggacagcgcgttgggcatgtcgt

SEQ ID NO: 2830 - DNA, 17 bp, Homo sapiens
tcgggtggacccggtca

SEQ ID NO: 2831 - DNA, 17 bp, Homo sapiens
tgaccgggtccacccga

SEQ ID NO: 2832 - DNA, 121 bp, Homo sapiens
acatgcccaacgcgctgtccgccctgagcgacctgcacgcgcacaagcttcgggtggacccggtcaacttcaaggtgagcggcgggccgggagcgatctgggtcgaggggcgagatggcgc

SEQ ID NO: 2833 - DNA, 121 bp, Homo sapiens
gcgccatctcgcccctcgacccagatcgctcccggcccgccgctcaccttgaagttgaccgggtccacccgaagcttgtgcgcgtgcaggtcgctcagggcggacagcgcgttgggcatgt

SEQ ID NO: 2834 - DNA, 17 bp, Homo sapiens
ggtggacccggtcaact

SEQ ID NO: 2835 - DNA, 17 bp, Homo sapiens
agttgaccgggtccacc

SEQ ID NO: 2836 - DNA, 121 bp, Homo sapiens
cggcggctgcgggcctgggccctcggccccactgaccctcttctctgcacagctcctaagccactgcctgctggtgaccctggccgcccacctccccgccgagttcacccctgcggtgcac

SEQ ID NO: 2837 - DNA, 121 bp, Homo sapiens
gtgcaccgcaggggtgaactcggcggggaggtgggcggccagggtcaccagcaggcagtggcttaggagctgtgcagagaagagggtcagtggggccgagggcccaggcccgcagccgccg

SEQ ID NO: 2838 - DNA, 17 bp, Homo sapiens
ctcctaagccactgcct

SEQ ID NO: 2839 - DNA, 17 bp, Homo sapiens
aggcagtggcttaggag

SEQ ID NO: 2840 - DNA, 121 bp, Homo sapiens
ttctctgcacagctcctaagccactgcctgctggtgaccctggccgcccacctccccgccgagttcacccctgcggtgcacgcctccctggacaagttcctggcttctgtgagcaccgtgc

SEQ ID NO: 2841 - DNA, 121 bp, Homo sapiens
gcacggtgctcacagaagccaggaacttgtccagggaggcgtgcaccgcaggggtgaactcggcggggaggtgggcggccagggtcaccagcaggcagtggcttaggagctgtgcagagaa

SEQ ID NO: 2842 - DNA, 17 bp, Homo sapiens
tccccgccgagttcacc

SEQ ID NO: 2843 - DNA, 17 bp, Homo sapiens
ggtgaactcggcgggga

SEQ ID NO: 2844 - DNA, 121 bp, Homo sapiens
tcctaagccactgcctgctggtgaccctggccgcccacctccccgccgagttcacccctgcggtgcacgcctccctggacaagttcctggcttctgtgagcaccgtgctgacctccaaata

SEQ ID NO: 2845 - DNA, 121 bp, Homo sapiens
tatttggaggtcagcacggtgctcacagaagccaggaacttgtccagggaggcgtgcaccgcaggggtgaactcggcggggaggtgggcggccagggtcaccagcaggcagtggcttagga

SEQ ID NO: 2846 - DNA, 17 bp, Homo sapiens
cacccctgcggtgcacg

SEQ ID NO: 2847 - DNA, 17 bp, Homo sapiens
cgtgcaccgcaggggtg

SEQ ID NO: 2848 - DNA, 121 bp, Homo sapiens
tggccgcccacctccccgccgagttcacccctgcggtgcacgcctccctggacaagttcctggcttctgtgagcaccgtgctgacctccaaataccgttaagctggagcctcggtggccat

SEQ ID NO: 2849 - DNA, 121 bp, Homo sapiens
atggccaccgaggctccagcttaacggtatttggaggtcagcacggtgctcacagaagccaggaacttgtccagggaggcgtgcaccgcaggggtgaactcggcggggaggtgggcggcca

SEQ ID NO: 2850 - DNA, 17 bp, Homo sapiens
caagttcctggcttctg

SEQ ID NO: 2851 - DNA, 17 bp, Homo sapiens
cagaagccaggaacttg

SEQ ID NO: 2852 - DNA, 121 bp, Homo sapiens
tgcacgcctccctggacaagttcctggcttctgtgagcaccgtgctgacctccaaataccgttaagctggagcctcggtggccatgcttcttgccccttgggcctccccccagcccctcct

SEQ ID NO: 2853 - DNA, 121 bp, Homo sapiens
aggaggggctggggggaggcccaaggggcaagaagcatggccaccgaggctccagcttaacggtatttggaggtcagcacggtgctcacagaagccaggaacttgtccagggaggcgtgca

SEQ ID NO: 2854 - DNA, 17 bp, Homo sapiens
caaataccgttaagctg

SEQ ID NO: 2855 - DNA, 17 bp, Homo sapiens
cagcttaacggtatttg

SEQ ID NO: 2856 - DNA, 121 bp, Homo sapiens
cctggcgcgctcgcgggccggcactcttctggtccccacagactcagagagaacccaccatggtgctgtctcctgccgacaagaccaacgtcaaggccgcctggggtaaggtcggcgcgca

SEQ ID NO: 2857 - DNA, 121 bp, Homo sapiens
tgcgcgccgaccttaccccaggcggccttgacgttggtcttgtcggcaggagacagcaccatggtgggttctctctgagtctgtggggaccagaagagtgccggcccgcgagcgcgccagg

SEQ ID NO: 2858 - DNA, 17 bp, Homo sapiens
acccaccatggtgctgt

SEQ ID NO: 2859 - DNA, 17 bp, Homo sapiens
acagcaccatggtgggt

SEQ ID NO: 2860 - DNA, 121 bp, Homo sapiens; identical to SEQ ID NO: 2780

SEQ ID NO: 2861 - DNA, 121 bp, Homo sapiens; identical to SEQ ID NO: 2781

SEQ ID NO: 2862 - DNA, 17 bp, Homo sapiens
cgtcaaggccgcctggg

SEQ ID NO: 2863 - DNA, 17 bp, Homo sapiens
cccaggcggccttgacg

SEQ ID NO: 2864 - DNA, 121 bp, Homo sapiens
agagaacccaccatggtgctgtctcctgccgacaagaccaacgtcaaggccgcctggggtaaggtcggcgcgcacgctggcgagtatggtgcggaggccctggagaggtgaggctccctcc

SEQ ID NO: 2865 - DNA, 121 bp, Homo sapiens
ggagggagcctcacctctccagggcctccgcaccatactcgccagcgtgcgcgccgaccttaccccaggcggccttgacgttggtcttgtcggcaggagacagcaccatggtgggttctct

SEQ ID NO: 2866 - DNA, 17 bp, Homo sapiens
cctggggtaaggtcggc

SEQ ID NO: 2867 - DNA, 17 bp, Homo sapiens
gccgaccttaccccagg

SEQ ID NO: 2868 - DNA, 121 bp, Homo sapiens
ggtgctgtctcctgccgacaagaccaacgtcaaggccgcctggggtaaggtcggcgcgcacgctggcgagtatggtgcggaggccctggagaggtgaggctccctcccctgctccgacccg

SEQ ID NO: 2869 - DNA, 121 bp, Homo sapiens
cgggtcggagcaggggagggagcctcacctctccagggcctccgcaccatactcgccagcgtgcgcgccgaccttaccccaggcggccttgacgttggtcttgtcggcaggagacagcacc

SEQ ID NO: 2870 - DNA, 17 bp, Homo sapiens
ggcgcgcacgctggcga

SEQ ID NO: 2871 - DNA, 17 bp, Homo sapiens
tcgccagcgtgcgcgcc

SEQ ID NO: 2872 - DNA, 121 bp, Homo sapiens; identical to SEQ ID NO: 2792

SEQ ID NO: 2873 - DNA, 121 bp, Homo sapiens; identical to SEQ ID NO: 2793

SEQ ID NO: 2874 - DNA, 17 bp, Homo sapiens
ggtgcggaggccctgga

SEQ ID NO: 2875 - DNA, 17 bp, Homo sapiens
tccagggcctccgcacc

SEQ ID NO: 2876 - DNA, 121 bp, Homo sapiens
acgtcaaggccgcctggggtaaggtcggcgcgcacgctggcgagtatggtgcggaggccctggagaggtgaggctccctcccctgctccgacccgggctcctcgcccgcccggacccacag

SEQ ID NO: 2877 - DNA, 121 bp, Homo sapiens
ctgtgggtccgggcgggcgaggagcccgggtcggagcaggggagggagcctcacctctccagggcctccgcaccatactcgccagcgtgcgcgccgaccttaccccaggcggccttgacgt

SEQ ID NO: 2878 - DNA, 17 bp, Homo sapiens
ggaggccctggagaggt

SEQ ID NO: 2879 - DNA, 17 bp, Homo sapiens
acctctccagggcctcc

SEQ ID NO: 2880 - DNA, 121 bp, Homo sapiens
gcttctccccgcaggatgttcctgtccttccccaccaccaagacctacttcccgcacttcgacctgagccacggctctgcccaggttaagggccacggcaagaaggtggccgacgcgctga

SEQ ID NO: 2881 - DNA, 121 bp, Homo sapiens
tcagcgcgtcggccaccttcttgccgtggcccttaacctgggcagagccgtggctcaggtcgaagtgcgggaagtaggtcttggtggtggggaaggacaggaacatcctgcggggagaagc

SEQ ID NO: 2882 - DNA, 17 bp, Homo sapiens
cgcacttcgacctgagc

SEQ ID NO: 2883 - DNA, 17 bp, Homo sapiens
gctcaggtcgaagtgcg

SEQ ID NO: 2884 - DNA, 121 bp, Homo sapiens
ctccccgcaggatgttcctgtccttccccaccaccaagacctacttcccgcacttcgacctgagccacggctctgcccaggttaagggccacggcaagaaggtggccgacgcgctgaccaa

SEQ ID NO: 2885 - DNA, 121 bp, Homo sapiens
ttggtcagcgcgtcggccaccttcttgccgtggcccttaacctgggcagagccgtggctcaggtcgaagtgcgggaagtaggtcttggtggtggggaaggacaggaacatcctgcggggag

SEQ ID NO: 2886 - DNA, 17 bp, Homo sapiens
cttcgacctgagccacg

SEQ ID NO: 2887 - DNA, 17 bp, Homo sapiens
cgtggctcaggtcgaag

SEQ ID NO: 2888 - DNA, 121 bp, Homo sapiens
ctgtccttccccaccaccaagacctacttcccgcacttcgacctgagccacggctctgcccaggttaagggccacggcaagaaggtggccgacgcgctgaccaacgccgtggcgcacgtgg

SEQ ID NO: 2889 - DNA, 121 bp, Homo sapiens
ccacgtgcgccacggcgttggtcagcgcgtcggccaccttcttgccgtggcccttaacctgggcagagccgtggctcaggtcgaagtgcgggaagtaggtcttggtggtggggaaggacag

SEQ ID NO: 2890 - DNA, 17 bp, Homo sapiens
gctctgcccaggttaag

SEQ ID NO: 2891 - DNA, 17 bp, Homo sapiens
cttaacctgggcagagc

SEQ ID NO: 2892 - DNA, 121 bp, Homo sapiens
ccaagacctacttcccgcacttcgacctgagccacggctctgcccaggttaagggccacggcaagaaggtggccgacgcgctgaccaacgccgtggcgcacgtggacgacatgcccaacgc

SEQ ID NO: 2893 - DNA, 121 bp, Homo sapiens
gcgttgggcatgtcgtccacgtgcgccacggcgttggtcagcgcgtcggccaccttcttgccgtggcccttaacctgggcagagccgtggctcaggtcgaagtgcgggaagtaggtcttgg

SEQ ID NO: 2894 - DNA, 17 bp, Homo sapiens
gggccacggcaagaagg

SEQ ID NO: 2895 - DNA, 17 bp, Homo sapiens
ccttcttgccgtggccc

SEQ ID NO: 2896 - DNA, 121 bp, Homo sapiens; identical to SEQ ID NO: 2796

SEQ ID NO: 2897 - DNA, 121 bp, Homo sapiens; identical to SEQ ID NO: 2797

SEQ ID NO: 2898 - DNA, 17 bp, Homo sapiens
ctgaccaacgccgtggc

SEQ ID NO: 2899 - DNA, 17 bp, Homo sapiens
gccacggcgttggtcag

SEQ ID NO: 2900 - DNA, 121 bp, Homo sapiens; identical to SEQ ID NO: 2796

SEQ ID NO: 2901 - DNA, 121 bp, Homo sapiens; identical to SEQ ID NO: 2797

SEQ ID NO: 2902 - DNA, 17 bp, Homo sapiens
ctgaccaacgccgtggc

SEQ ID NO: 2903 - DNA, 17 bp, Homo sapiens
gccacggcgttggtcag

SEQ ID NO: 2904 - DNA, 121 bp, Homo sapiens
cggcaagaaggtggccgacgcgctgaccaacgccgtggcgcacgtggacgacatgcccaacgcgctgtccgccctgagcgacctgcacgcgcacaagcttcgggtggacccggtcaacttc

SEQ ID NO: 2905 - DNA, 121 bp, Homo sapiens
gaagttgaccgggtccacccgaagcttgtgcgcgtgcaggtcgctcagggcggacagcgcgttgggcatgtcgtccacgtgcgccacggcgttggtcagcgcgtcggccaccttcttgccg

SEQ ID NO: 2906 - DNA, 17 bp, Homo sapiens
atgcccaacgcgctgtc

SEQ ID NO: 2907 - DNA, 17 bp, Homo sapiens
gacagcgcgttgggcat

SEQ ID NO: 2908 - DNA, 121 bp, Homo sapiens
cgctgaccaacgccgtggcgcacgtggacgacatgcccaacgcgctgtccgccctgagcgacctgcacgcgcacaagcttcgggtggacccggtcaacttcaaggtgagcggcgggccggg

SEQ ID NO: 2909 - DNA, 121 bp, Homo sapiens
cccggcccgccgctcaccttgaagttgaccgggtccacccgaagcttgtgcgcgtgcaggtcgctcagggcggacagcgcgttgggcatgtcgtccacgtgcgccacggcgttggtcagcg

SEQ ID NO: 2910 - DNA, 17 bp, Homo sapiens
cctgagcgacctgcacg

SEQ ID NO: 2911 - DNA, 17 bp, Homo sapiens
cgtgcaggtcgctcagg

SEQ ID NO: 2912 - DNA, 121 bp, Homo sapiens; identical to SEQ ID NO: 2816

SEQ ID NO: 2913 - DNA, 121 bp, Homo sapiens; identical to SEQ ID NO: 2817

SEQ ID NO: 2914 - DNA, 17 bp, Homo sapiens
gcgcacaagcttcgggt

SEQ ID NO: 2915 - DNA, 17 bp, Homo sapiens
acccgaagcttgtgcgc

SEQ ID NO: 2916 - DNA, 121 bp, Homo sapiens
gacgacatgcccaacgcgctgtccgccctgagcgacctgcacgcgcacaagcttcgggtggacccggtcaacttcaaggtgagcggcgggccgggagcgatctgggtcgaggggcgagatg

SEQ ID NO: 2917 - DNA, 121 bp, Homo sapiens
catctcgcccctcgacccagatcgctcccggcccgccgctcaccttgaagttgaccgggtccacccgaagcttgtgcgcgtgcaggtcgctcagggcggacagcgcgttgggcatgtcgtc

SEQ ID NO: 2918 - DNA, 17 bp, Homo sapiens
ttcgggtggacccggtc

SEQ ID NO: 2919 - DNA, 17 bp, Homo sapiens
gaccgggtccacccgaa

SEQ ID NO: 2920 - DNA, 121 bp, Homo sapiens; identical to SEQ ID NO: 2832

SEQ ID NO: 2921 - DNA, 121 bp, Homo sapiens; identical to SEQ ID NO: 2833

SEQ ID NO: 2922 - DNA, 17 bp, Homo sapiens
ggtggacccggtcaact

SEQ ID NO: 2923 - DNA, 17 bp, Homo sapiens
agttgaccgggtccacc

SEQ ID NO: 2924 - DNA, 121 bp, Homo sapiens
tagcgcaggcggcggctgcgggcctgggccgcactgaccctcttctctgcacagctcctaagccactgcctgctggtgaccctggccgcccacctccccgccgagttcacccctgcggtgc

SEQ ID NO: 2925 - DNA, 121 bp, Homo sapiens
gcaccgcaggggtgaactcggcggggaggtgggcggccagggtcaccagcaggcagtggcttaggagctgtgcagagaagagggtcagtgcggcccaggcccgcagccgccgcctgcgcta

SEQ ID NO: 2926 - DNA, 17 bp, Homo sapiens
agctcctaagccactgc

SEQ ID NO: 2927 - DNA, 17 bp, Homo sapiens
gcagtggcttaggagct

SEQ ID NO: 2928 - DNA, 121 bp, Homo sapiens
ggcggcggctgcgggcctgggccgcactgaccctcttctctgcacagctcctaagccactgcctgctggtgaccctggccgcccacctccccgccgagttcacccctgcggtgcacgcctc

SEQ ID NO: 2929 - DNA, 121 bp, Homo sapiens
gaggcgtgcaccgcaggggtgaactcggcggggaggtgggcggccagggtcaccagcaggcagtggcttaggagctgtgcagagaagagggtcagtgcggcccaggcccgcagccgccgcc

SEQ ID NO: 2930 - DNA, 17 bp, Homo sapiens
aagccactgcctgctgg

SEQ ID NO: 2931 - DNA, 17 bp, Homo sapiens
ccagcaggcagtggctt

SEQ ID NO: 2932 - DNA, 121 bp, Homo sapiens
ccgcactgaccctcttctctgcacagctcctaagccactgcctgctggtgaccctggccgcccacctccccgccgagttcacccctgcggtgcacgcctccctggacaagttcctggcttc

SEQ ID NO: 2933 - DNA, 121 bp, Homo sapiens
gaagccaggaacttgtccagggaggcgtgcaccgcaggggtgaactcggcggggaggtgggcggccagggtcaccagcaggcagtggcttaggagctgtgcagagaagagggtcagtgcgg

SEQ ID NO: 2934 - DNA, 17 bp, Homo sapiens
cctggccgcccacctcc

SEQ ID NO: 2935 - DNA, 17 bp, Homo sapiens
ggaggtgggcggccagg

SEQ ID NO: 2936 - DNA, 121 bp, Homo sapiens; identical to SEQ ID NO: 2844

SEQ ID NO: 2937 - DNA, 121 bp, Homo sapiens; identical to SEQ ID NO: 2845

SEQ ID NO: 2938 - DNA, 17 bp, Homo sapiens
cacccctgcggtgcacg

SEQ ID NO: 2939 - DNA, 17 bp, Homo sapiens
cgtgcaccgcaggggtg

SEQ ID NO: 2940 - DNA, 121 bp, Homo sapiens
ccactgcctgctggtgaccctggccgcccacctccccgccgagttcacccctgcggtgcacgcctccctggacaagttcctggcttctgtgagcaccgtgctgacctccaaataccgttaa

SEQ ID NO: 2941 - DNA, 121 bp, Homo sapiens
ttaacggtatttggaggtcagcacggtgctcacagaagccaggaacttgtccagggaggcgtgcaccgcaggggtgaactcggcggggaggtgggcggccagggtcaccagcaggcagtgg

SEQ ID NO: 2942 - DNA, 17 bp, Homo sapiens
gcggtgcacgcctccct

SEQ ID NO: 2943 - DNA, 17 bp, Homo sapiens
agggaggcgtgcaccgc

SEQ ID NO: 2944 - DNA, 121 bp, Homo sapiens
cactgcctgctggtgaccctggccgcccacctccccgccgagttcacccctgcggtgcacgcctccctggacaagttcctggcttctgtgagcaccgtgctgacctccaaataccgttaag

SEQ ID NO: 2945 - DNA, 121 bp, Homo sapiens
cttaacggtatttggaggtcagcacggtgctcacagaagccaggaacttgtccagggaggcgtgcaccgcaggggtgaactcggcggggaggtgggcggccagggtcaccagcaggcagtg

SEQ ID NO: 2946 - DNA, 17 bp, Homo sapiens
cggtgcacgcctccctg

SEQ ID NO: 2947 - DNA, 17 bp, Homo sapiens
cagggaggcgtgcaccg

SEQ ID NO: 2948 - DNA, 121 bp, Homo sapiens
tgctggtgaccctggccgcccacctccccgccgagttcacccctgcggtgcacgcctccctggacaagttcctggcttctgtgagcaccgtgctgacctccaaataccgttaagctggagc

SEQ ID NO: 2949 - DNA, 121 bp, Homo sapiens
gctccagcttaacggtatttggaggtcagcacggtgctcacagaagccaggaacttgtccagggaggcgtgcaccgcaggggtgaactcggcggggaggtgggcggccagggtcaccagca

SEQ ID NO: 2950 - DNA, 17 bp, Homo sapiens
cgcctccctggacaagt

SEQ ID NO: 2951 - DNA, 17 bp, Homo sapiens
acttgtccagggaggcg

SEQ ID NO: 2952 - DNA, 121 bp, Homo sapiens
gcccacctccccgccgagttcacccctgcggtgcacgcctccctggacaagttcctggcttctgtgagcaccgtgctgacctccaaataccgttaagctggagcctcggtagccgttcctc

SEQ ID NO: 2953 - DNA, 121 bp, Homo sapiens
gaggaacggctaccgaggctccagcttaacggtatttggaggtcagcacggtgctcacagaagccaggaacttgtccagggaggcgtgcaccgcaggggtgaactcggcggggaggtgggc

SEQ ID NO: 2954 - DNA, 17 bp, Homo sapiens
tcctggcttctgtgagc

SEQ ID NO: 2955 - DNA, 17 bp, Homo sapiens
gctcacagaagccagga

SEQ ID NO: 2956 - DNA, 121 bp, Homo sapiens
gagttcacccctgcggtgcacgcctccctggacaagttcctggcttctgtgagcaccgtgctgacctccaaataccgttaagctggagcctcggtagccgttcctcctgcccgctgggcct

SEQ ID NO: 2957 - DNA, 121 bp, Homo sapiens
aggcccagcgggcaggaggaacggctaccgaggctccagcttaacggtatttggaggtcagcacggtgctcacagaagccaggaacttgtccagggaggcgtgcaccgcaggggtgaactc

SEQ ID NO: 2958 - DNA, 17 bp, Homo sapiens
gcaccgtgctgacctcc

SEQ ID NO: 2959 - DNA, 17 bp, Homo sapiens
ggaggtcagcacggtgc

SEQ ID NO: 2960 - DNA, 121 bp, Homo sapiens
agttcacccctgcggtgcacgcctccctggacaagttcctggcttctgtgagcaccgtgctgacctccaaataccgttaagctggagcctcggtagccgttcctcctgcccgctgggcctc

SEQ ID NO: 2961 - DNA, 121 bp, Homo sapiens
gaggcccagcgggcaggaggaacggctaccgaggctccagcttaacggtatttggaggtcagcacggtgctcacagaagccaggaacttgtccagggaggcgtgcaccgcaggggtgaact

SEQ ID NO: 2962 - DNA, 17 bp, Homo sapiens
caccgtgctgacctcca

SEQ ID NO: 2963 - DNA, 17 bp, Homo sapiens
tggaggtcagcacggtg

SEQ ID NO: 2964 - DNA, 121 bp, Homo sapiens
gtgcacgcctccctggacaagttcctggcttctgtgagcaccgtgctgacctccaaataccgttaagctggagcctcggtagccgttcctcctgcccgctgggcctcccaacgggccctcc

SEQ ID NO: 2965 - DNA, 121 bp, Homo sapiens
ggagggcccgttgggaggcccagcgggcaggaggaacggctaccgaggctccagcttaacggtatttggaggtcagcacggtgctcacagaagccaggaacttgtccagggaggcgtgcac

SEQ ID NO: 2966 - DNA, 17 bp, Homo sapiens
ccaaataccgttaagct

SEQ ID NO: 2967 - DNA, 17 bp, Homo sapiens
agcttaacggtatttgg

SEQ ID NO: 2968 - DNA, 121 bp, Homo sapiens
cacgcctccctggacaagttcctggcttctgtgagcaccgtgctgacctccaaataccgttaagctggagcctcggtagccgttcctcctgcccgctgggcctcccaacgggccctcctcc

SEQ ID NO: 2969 - DNA, 121 bp, Homo sapiens
ggaggagggcccgttgggaggcccagcgggcaggaggaacggctaccgaggctccagcttaacggtatttggaggtcagcacggtgctcacagaagccaggaacttgtccagggaggcgtg

SEQ ID NO: 2970 - DNA, 17 bp, Homo sapiens
aataccgttaagctgga

SEQ ID NO: 2971 - DNA, 17 bp, Homo sapiens
tccagcttaacggtatt

SEQ ID NO: 2972 - DNA, 121 bp, Homo sapiens; identical to SEQ ID NO: 2968

SEQ ID NO: 2973 - DNA, 121 bp, Homo sapiens; identical to SEQ ID NO: 2969

SEQ ID NO: 2974 - DNA, 17 bp, Homo sapiens
aataccgttaagctgga

SEQ ID NO: 2975 - DNA, 17 bp, Homo sapiens
tccagcttaacggtatt

SEQ ID NO: 2976 - DNA, 121 bp, Homo sapiens
cgcctccctggacaagttcctggcttctgtgagcaccgtgctgacctccaaataccgttaagctggagcctcggtagccgttcctcctgcccgctgggcctcccaacgggccctcctcccc

SEQ ID NO: 2977 - DNA, 121 bp, Homo sapiens
ggggaggagggcccgttgggaggcccagcgggcaggaggaacggctaccgaggctccagcttaacggtatttggaggtcagcacggtgctcacagaagccaggaacttgtccagggaggcg

SEQ ID NO: 2978 - DNA, 17 bp, Homo sapiens
taccgttaagctggagc

SEQ ID NO: 2979 - DNA, 17 bp, Homo sapiens
gctccagcttaacggta

SEQ ID NO: 2980 - DNA, 121 bp, Homo sapiens
ttggctgaaggcacttccgttgagcatctagacgtttccttggctcttctggcgccaaaatgtcgttcgtggcaggggttattcggcggctggacgagacagtggtgaaccgcatcgcggc

SEQ ID NO: 2981 - DNA, 121 bp, Homo sapiens
gccgcgatgcggttcaccactgtctcgtccagccgccgaataacccctgccacgaacgacattttggcgccagaagagccaaggaaacgtctagatgctcaacggaagtgccttcagccaa

SEQ ID NO: 2982 - DNA, 17 bp, Homo sapiens
cgccaaaatgtcgttcg

SEQ ID NO: 2983 - DNA, 17 bp, Homo sapiens
cgaacgacattttggcg

SEQ ID NO: 2984 - DNA, 121 bp, Homo sapiens; identical to SEQ ID NO: 2980

SEQ ID NO: 2985 - DNA, 121 bp, Homo sapiens; identical to SEQ ID NO: 2981

SEQ ID NO: 2986 - DNA, 17 bp, Homo sapiens
cgccaaaatgtcgttcg

SEQ ID NO: 2987 - DNA, 17 bp, Homo sapiens
cgaacgacattttggcg

SEQ ID NO: 2988 - DNA, 121 bp, Homo sapiens
tggtgaaccgcatcgcggcgggggaagttatccagcggccagctaatgctatcaaagagatgattgagaactggtacggagggagtcgagccgggctcacttaagggctacgacttaacgg

SEQ ID NO: 2989 - DNA, 121 bp, Homo sapiens
ccgttaagtcgtagcccttaagtgagcccggctcgactccctccgtaccagttctcaatcatctctttgatagcattagctggccgctggataacttcccccgccgcgatgcggttcacca

SEQ ID NO: 2990 - DNA, 17 bp, Homo sapiens
caaagagatgattgaga

SEQ ID NO: 2991 - DNA, 17 bp, Homo sapiens
tctcaatcatctctttg

SEQ ID NO: 2992 - DNA, 121 bp, Homo sapiens
tagagtagttgcagactgataaattattttctgtttgatttgccagtttagatgcaaaatccacaagtattcaagtgattgttaaagagggaggcctgaagttgattcagatccaagacaa

SEQ ID NO: 2993 - DNA, 121 bp, Homo sapiens
ttgtcttggatctgaatcaacttcaggcctccctctttaacaatcacttgaatacttgtggattttgcatctaaactggcaaatcaaacagaaaataatttatcagtctgcaactactcta

SEQ ID NO: 2994 - DNA, 17 bp, Homo sapiens
tgcaaaatccacaagta

SEQ ID NO: 2995 - DNA, 17 bp, Homo sapiens
tacttgtggattttgca

SEQ ID NO: 2996 - DNA, 121 bp, Homo sapiens
gcaaaatccacaagtattcaagtgattgttaaagagggaggcctgaagttgattcagatccaagacaatggcaccgggatcagggtaagtaaaacctcaaagtagcaggatgtttgtgcgc

SEQ ID NO: 2997 - DNA, 121 bp, Homo sapiens
gcgcacaaacatcctgctactttgaggttttacttaccctgatcccggtgccattgtcttggatctgaatcaacttcaggcctccctctttaacaatcacttgaatacttgtggattttgc

SEQ ID NO: 2998 - DNA, 17 bp, Homo sapiens
ttcagatccaagacaat

SEQ ID NO: 2999 - DNA, 17 bp, Homo sapiens
attgtcttggatctgaa

SEQ ID NO: 3000 - DNA, 121 bp, Homo sapiens; identical to SEQ ID NO: 2996

SEQ ID NO: 3001 - DNA, 121 bp, Homo sapiens; identical to SEQ ID NO: 2997

SEQ ID NO: 3002 - DNA, 17 bp, Homo sapiens
ttcagatccaagacaat

SEQ ID NO: 3003 - DNA, 17 bp, Homo sapiens
attgtcttggatctgaa

SEQ ID NO: 3004 - DNA, 121 bp, Homo sapiens
ccacaagtattcaagtgattgttaaagagggaggcctgaagttgattcagatccaagacaatggcaccgggatcagggtaagtaaaacctcaaagtagcaggatgtttgtgcgcttcatgg

SEQ ID NO: 3005 - DNA, 121 bp, Homo sapiens
ccatgaagcgcacaaacatcctgctactttgaggttttacttaccctgatcccggtgccattgtcttggatctgaatcaacttcaggcctccctctttaacaatcacttgaatacttgtgg

SEQ ID NO: 3006 - DNA, 17 bp, Homo sapiens
ccaagacaatggcaccg

SEQ ID NO: 3007 - DNA, 17 bp, Homo sapiens
cggtgccattgtcttgg

SEQ ID NO: 3008 - DNA, 121 bp, Homo sapiens
attcaagtgattgttaaagagggaggcctgaagttgattcagatccaagacaatggcaccgggatcagggtaagtaaaacctcaaagtagcaggatgtttgtgcgcttcatggaagagtca

SEQ ID NO: 3009 - DNA, 121 bp, Homo sapiens
tgactcttccatgaagcgcacaaacatcctgctactttgaggttttacttaccctgatcccggtgccattgtcttggatctgaatcaacttcaggcctccctctttaacaatcacttgaat

SEQ ID NO: 3010 - DNA, 17 bp, Homo sapiens
atggcaccgggatcagg

SEQ ID NO: 3011 - DNA, 17 bp, Homo sapiens
cctgatcccggtgccat

SEQ ID NO: 3012 - DNA, 121 bp, Homo sapiens; identical to SEQ ID NO: 3008

SEQ ID NO: 3013 - DNA, 121 bp, Homo sapiens; identical to SEQ ID NO: 3009

SEQ ID NO: 3014 - DNA, 17 bp, Homo sapiens
atggcaccgggatcagg

SEQ ID NO: 3015 - DNA, 17 bp, Homo sapiens
cctgatcccggtgccat

SEQ ID NO: 3016 - DNA, 121 bp, Homo sapiens; identical to SEQ ID NO: 3008

SEQ ID NO: 3017 - DNA, 121 bp, Homo sapiens; identical to SEQ ID NO: 3009

SEQ ID NO: 3018 - DNA, 17 bp, Homo sapiens
atggcaccgggatcagg

SEQ ID NO: 3019 - DNA, 17 bp, Homo sapiens
cctgatcccggtgccat

SEQ ID NO: 3020 - DNA, 121 bp, Homo sapiens
gtaacatgattatttactcatctttttggtatctaacagaaagaagatctggatattgtatgtgaaaggttcactactagtaaactgcagtcctttgaggatttagccagtatttctacct

SEQ ID NO: 3021 - DNA, 121 bp, Homo sapiens
aggtagaaatactggctaaatcctcaaaggactgcagtttactagtagtgaacctttcacatacaatatccagatcttctttctgttagataccaaaaagatgagtaaataatcatgttac

SEQ ID NO: 3022 - DNA, 17 bp, Homo sapiens
atattgtatgtgaaagg

SEQ ID NO: 3023 - DNA, 17 bp, Homo sapiens
cctttcacatacaatat

SEQ ID NO: 3024 - DNA, 121 bp, Homo sapiens
taacatgattatttactcatctttttggtatctaacagaaagaagatctggatattgtatgtgaaaggttcactactagtaaactgcagtcctttgaggatttagccagtatttctaccta

SEQ ID NO: 3025 - DNA, 121 bp, Homo sapiens
taggtagaaatactggctaaatcctcaaaggactgcagtttactagtagtgaacctttcacatacaatatccagatcttctttctgttagataccaaaaagatgagtaaataatcatgtta

SEQ ID NO: 3026 - DNA, 17 bp, Homo sapiens
tattgtatgtgaaaggt

SEQ ID NO: 3027 - DNA, 17 bp, Homo sapiens
acctttcacatacaata

SEQ ID NO: 3028 - DNA, 121 bp, Homo sapiens
ctggatattgtatgtgaaaggttcactactagtaaactgcagtcctttgaggatttagccagtatttctacctatggctttcgaggtgaggtaagctaaagattcaagaaatgtgtaaaat

SEQ ID NO: 3029 - DNA, 121 bp, Homo sapiens
attttacacatttcttgaatctttagcttacctcacctcgaaagccataggtagaaatactggctaaatcctcaaaggactgcagtttactagtagtgaacctttcacatacaatatccag

SEQ ID NO: 3030 - DNA, 17 bp, Homo sapiens
atttagccagtatttct

SEQ ID NO: 3031 - DNA, 17 bp, Homo sapiens
agaaatactggctaaat

SEQ ID NO: 3032 - DNA, 121 bp, Homo sapiens
ttcactactagtaaactgcagtcctttgaggatttagccagtatttctacctatggctttcgaggtgaggtaagctaaagattcaagaaatgtgtaaaatatcctcctgtgatgacattgt

SEQ ID NO: 3033 - DNA, 121 bp, Homo sapiens
acaatgtcatcacaggaggatattttacacatttcttgaatctttagcttacctcacctcgaaagccataggtagaaatactggctaaatcctcaaaggactgcagtttactagtagtgaa

SEQ ID NO: 3034 - DNA, 17 bp, Homo sapiens
atggctttcgaggtgag

SEQ ID NO: 3035 - DNA, 17 bp, Homo sapiens
ctcacctcgaaagccat

SEQ ID NO: 3036 - DNA, 121 bp, Homo sapiens
acccagcagtgagtttttctttcagtctattttcttttcttccttaggctttggccagcataagccatgtggctcatgttactattacaacgaaaacagctgatggaaagtgtgcatacag

SEQ ID NO: 3037 - DNA, 121 bp, Homo sapiens
ctgtatgcacactttccatcagctgttttcgttgtaatagtaacatgagccacatggcttatgctggccaaagcctaaggaagaaaagaaaatagactgaaagaaaaactcactgctgggt

SEQ ID NO: 3038 - DNA, 17 bp, Homo sapiens
ggccagcataagccatg

SEQ ID NO: 3039 - DNA, 17 bp, Homo sapiens
catggcttatgctggcc

SEQ ID NO: 3040 - DNA, 121 bp, Homo sapiens
tttcttttcttccttaggctttggccagcataagccatgtggctcatgttactattacaacgaaaacagctgatggaaagtgtgcatacaggtatagtgctgacttcttttactcatatat

SEQ ID NO: 3041 - DNA, 121 bp, Homo sapiens
atatatgagtaaaagaagtcagcactatacctgtatgcacactttccatcagctgttttcgttgtaatagtaacatgagccacatggcttatgctggccaaagcctaaggaagaaaagaaa

SEQ ID NO: 3042 - DNA, 17 bp, Homo sapiens
tattacaacgaaaacag

SEQ ID NO: 3043 - DNA, 17 bp, Homo sapiens
ctgttttcgttgtaata

SEQ ID NO: 3044 - DNA, 121 bp, Homo sapiens; identical to SEQ ID NO: 3040

SEQ ID NO: 3045 - DNA, 121 bp, Homo sapiens; identical to SEQ ID NO: 3041

SEQ ID NO: 3046 - DNA, 17 bp, Homo sapiens
tattacaacgaaaacag

SEQ ID NO: 3047 - DNA, 17 bp, Homo sapiens
ctgttttcgttgtaata

SEQ ID NO: 3048 - DNA, 121 bp, Homo sapiens
tctatctctctactggatattaatttgttatattttctcattagagcaagttactcagatggaaaactgaaagcccctcctaaaccatgtgctggcaatcaagggacccagatcacggtaa

SEQ ID NO: 3049 - DNA, 121 bp, Homo sapiens
ttaccgtgatctgggtcccttgattgccagcacatggtttaggaggggctttcagttttccatctgagtaacttgctctaatgagaaaatataacaaattaatatccagtagagagataga

SEQ ID NO: 3050 - DNA, 17 bp, Homo sapiens
actcagatggaaaactg

SEQ ID NO: 3051 - DNA, 17 bp, Homo sapiens
cagttttccatctgagt

SEQ ID NO: 3052 - DNA, 121 bp, Homo sapiens
tagtgtgtgtttttggcaactcttttcttactcttttgtttttcttttccaggtattcagtacacaatgcaggcattagtttctcagttaaaaaagtaagttcttggtttatgggggatgg

SEQ ID NO: 3053 - DNA, 121 bp, Homo sapiens
ccatcccccataaaccaagaacttacttttttaactgagaaactaatgcctgcattgtgtactgaatacctggaaaagaaaaacaaaagagtaagaaaagagttgccaaaaacacacacta

SEQ ID NO: 3054 - DNA, 17 bp, Homo sapiens
gtattcagtacacaatg

SEQ ID NO: 3055 - DNA, 17 bp, Homo sapiens
cattgtgtactgaatac

SEQ ID NO: 3056 - DNA, 121 bp, Homo sapiens
tttcttactcttttgtttttcttttccaggtattcagtacacaatgcaggcattagtttctcagttaaaaaagtaagttcttggtttatgggggatggttttgttttatgaaaagaaaaaa

SEQ ID NO: 3057 - DNA, 121 bp, Homo sapiens
ttttttcttttcataaaacaaaaccatcccccataaaccaagaacttacttttttaactgagaaactaatgcctgcattgtgtactgaatacctggaaaagaaaaacaaaagagtaagaaa

SEQ ID NO: 3058 - DNA, 17 bp, Homo sapiens
ttagtttctcagttaaa

SEQ ID NO: 3059 - DNA, 17 bp, Homo sapiens
tttaactgagaaactaa

SEQ ID NO: 3060 - DNA, 121 bp, Homo sapiens
tttgtttatcagcaaggagagacagtagctgatgttaggacactacccaatgcctcaaccgtggacaatattcgctccatctttggaaatgctgttagtcggtatgtcgataacctatata

SEQ ID NO: 3061 - DNA, 121 bp, Homo sapiens
tatataggttatcgacataccgactaacagcatttccaaagatggagcgaatattgtccacggttgaggcattgggtagtgtcctaacatcagctactgtctctccttgctgataaacaaa

SEQ ID NO: 3062 - DNA, 17 bp, Homo sapiens
cctcaaccgtggacaat

SEQ ID NO: 3063 - DNA, 17 bp, Homo sapiens
attgtccacggttgagg

SEQ ID NO: 3064 - DNA, 121 bp, Homo sapiens
caaggagagacagtagctgatgttaggacactacccaatgcctcaaccgtggacaatattcgctccatctttggaaatgctgttagtcggtatgtcgataacctatataaaaaaatctttt

SEQ ID NO: 3065 - DNA, 121 bp, Homo sapiens
aaaagatttttttatataggttatcgacataccgactaacagcatttccaaagatggagcgaatattgtccacggttgaggcattgggtagtgtcctaacatcagctactgtctctccttg

SEQ ID NO: 3066 - DNA, 17 bp, Homo sapiens
acaatattcgctccatc

SEQ ID NO: 3067 - DNA, 17 bp, Homo sapiens
gatggagcgaatattgt

SEQ ID NO: 3068 - DNA, 121 bp, Homo sapiens
gagacagtagctgatgttaggacactacccaatgcctcaaccgtggacaatattcgctccatctttggaaatgctgttagtcggtatgtcgataacctatataaaaaaatcttttacattt

SEQ ID NO: 3069 - DNA, 121 bp, Homo sapiens
aaatgtaaaagatttttttatataggttatcgacataccgactaacagcatttccaaagatggagcgaatattgtccacggttgaggcattgggtagtgtcctaacatcagctactgtctc

SEQ ID NO: 3070 - DNA, 17 bp, Homo sapiens
ttcgctccatctttgga

SEQ ID NO: 3071 - DNA, 17 bp, Homo sapiens
tccaaagatggagcgaa

SEQ ID NO: 3072 - DNA, 121 bp, Homo sapiens
ctaatagagaactgatagaaattggatgtgaggataaaaccctagccttcaaaatgaatggttacatatccaatgcaaactactcagtgaagaagtgcatcttcttactcttcatcaaccg

SEQ ID NO: 3073 - DNA, 121 bp, Homo sapiens
cggttgatgaagagtaagaagatgcacttcttcactgagtagtttgcattggatatgtaaccattcattttgaaggctagggttttatcctcacatccaatttctatcagttctctattag

SEQ ID NO: 3074 - DNA, 17 bp, Homo sapiens
aatgaatggttacatat

SEQ ID NO: 3075 - DNA, 17 bp, Homo sapiens
atatgtaaccattcatt

SEQ ID NO: 3076 - DNA, 121 bp, Homo sapiens
gatgtgaggataaaaccctagccttcaaaatgaatggttacatatccaatgcaaactactcagtgaagaagtgcatcttcttactcttcatcaaccgtaagttaaaaagaaccacatggga

SEQ ID NO: 3077 - DNA, 121 bp, Homo sapiens
tcccatgtggttctttttaacttacggttgatgaagagtaagaagatgcacttcttcactgagtagtttgcattggatatgtaaccattcattttgaaggctagggttttatcctcacatc

SEQ ID NO: 3078 - DNA, 17 bp, Homo sapiens
aaactactcagtgaaga

SEQ ID NO: 3079 - DNA, 17 bp, Homo sapiens
tcttcactgagtagttt

SEQ ID NO: 3080 - DNA, 121 bp, Homo sapiens
cacccctcaggacagttttgaactggttgctttctttttattgtttagatcgtctggtagaatcaacttccttgagaaaagccatagaaacagtgtatgcagcctatttgcccaaaaacac

SEQ ID NO: 3081 - DNA, 121 bp, Homo sapiens
gtgtttttgggcaaataggctgcatacactgtttctatggcttttctcaaggaagttgattctaccagacgatctaaacaataaaaagaaagcaaccagttcaaaactgtcctgaggggtg

SEQ ID NO: 3082 - DNA, 17 bp, Homo sapiens
tctggtagaatcaactt

SEQ ID NO: 3083 - DNA, 17 bp, Homo sapiens
aagttgattctaccaga

SEQ ID NO: 3084 - DNA, 121 bp, Homo sapiens
ccctcaggacagttttgaactggttgctttctttttattgtttagatcgtctggtagaatcaacttccttgagaaaagccatagaaacagtgtatgcagcctatttgcccaaaaacacaca

SEQ ID NO: 3085 - DNA, 121 bp, Homo sapiens
tgtgtgtttttgggcaaataggctgcatacactgtttctatggcttttctcaaggaagttgattctaccagacgatctaaacaataaaaagaaagcaaccagttcaaaactgtcctgaggg

SEQ ID NO: 3086 - DNA, 17 bp, Homo sapiens
ggtagaatcaacttcct

SEQ ID NO: 3087 - DNA, 17 bp, Homo sapiens
aggaagttgattctacc

SEQ ID NO: 3088 - DNA, 121 bp, Homo sapiens
ctttttctccccctcccactatctaaggtaattgttctctcttattttcctgacagtttagaaatcagtccccagaatgtggatgttaatgtgcaccccacaaagcatgaagttcacttcc

SEQ ID NO: 3089 - DNA, 121 bp, Homo sapiens
ggaagtgaacttcatgctttgtggggtgcacattaacatccacattctggggactgatttctaaactgtcaggaaaataagagagaacaattaccttagatagtgggagggggagaaaaag

SEQ ID NO: 3090 - DNA, 17 bp, Homo sapiens
acagtttagaaatcagt

SEQ ID NO: 3091 - DNA, 17 bp, Homo sapiens
actgatttctaaactgt

SEQ ID NO: 3092 - DNA, 121 bp, Homo sapiens
ctcccactatctaaggtaattgttctctcttattttcctgacagtttagaaatcagtccccagaatgtggatgttaatgtgcaccccacaaagcatgaagttcacttcctgcacgaggaga

SEQ ID NO: 3093 - DNA, 121 bp, Homo sapiens
tctcctcgtgcaggaagtgaacttcatgctttgtggggtgcacattaacatccacattctggggactgatttctaaactgtcaggaaaataagagagaacaattaccttagatagtgggag

SEQ ID NO: 3094 - DNA, 17 bp, Homo sapiens
tcagtccccagaatgtg

SEQ ID NO: 3095 - DNA, 17 bp, Homo sapiens
cacattctggggactga

SEQ ID NO: 3096 - DNA, 121 bp, Homo sapiens
atgtgcaccccacaaagcatgaagttcacttcctgcacgaggagagcatcctggagcgggtgcagcagcacatcgagagcaagctcctgggctccaattcctccaggatgtacttcaccca

SEQ ID NO: 3097 - DNA, 121 bp, Homo sapiens
tgggtgaagtacatcctggaggaattggagcccaggagcttgctctcgatgtgctgctgcacccgctccaggatgctctcctcgtgcaggaagtgaacttcatgctttgtggggtgcacat

SEQ ID NO: 3098 - DNA, 17 bp, Homo sapiens
ggagcgggtgcagcagc

SEQ ID NO: 3099 - DNA, 17 bp, Homo sapiens
gctgctgcacccgctcc

SEQ ID NO: 3100 - DNA, 121 bp, Homo sapiens
ccacaaagcatgaagttcacttcctgcacgaggagagcatcctggagcgggtgcagcagcacatcgagagcaagctcctgggctccaattcctccaggatgtacttcacccaggtcagggc

SEQ ID NO: 3101 - DNA, 121 bp, Homo sapiens
gccctgacctgggtgaagtacatcctggaggaattggagcccaggagcttgctctcgatgtgctgctgcacccgctccaggatgctctcctcgtgcaggaagtgaacttcatgctttgtgg

SEQ ID NO: 3102 - DNA, 17 bp, Homo sapiens
gcagcagcacatcgaga

SEQ ID NO: 3103 - DNA, 17 bp, Homo sapiens
tctcgatgtgctgctgc

SEQ ID NO: 3104 - DNA, 121 bp, Homo sapiens
caagtctgacctcgtcttctacttctggaagtagtgataaggtctatgcccaccagatggttcgtacagattcccgggaacagaagcttgatgcatttctgcagcctctgagcaaacccct

SEQ ID NO: 3105 - DNA, 121 bp, Homo sapiens
aggggtttgctcagaggctgcagaaatgcatcaagcttctgttcccgggaatctgtacgaaccatctggtgggcatagaccttatcactacttccagaagtagaagacgaggtcagacttg

SEQ ID NO: 3106 - DNA, 17 bp, Homo sapiens
ccagatggttcgtacag

SEQ ID NO: 3107 - DNA, 17 bp, Homo sapiens
ctgtacgaaccatctgg

SEQ ID NO: 3108 - DNA, 121 bp, Homo sapiens
agtggcagggctaggcagcaagatgaggagatgcttgaactcccagcccctgctgaagtggctgccaaaaatcagagcttggagggggatacaacaaaggggacttcagaaatgtcagaga

SEQ ID NO: 3109 - DNA, 121 bp, Homo sapiens
tctctgacatttctgaagtcccctttgttgtatccccctccaagctctgatttttggcagccacttcagcaggggctgggagttcaagcatctcctcatcttgctgcctagccctgccact

SEQ ID NO: 3110 - DNA, 17 bp, Homo sapiens
ctgaagtggctgccaaa

SEQ ID NO: 3111 - DNA, 17 bp, Homo sapiens
tttggcagccacttcag

SEQ ID NO: 3112 - DNA, 121 bp, Homo sapiens
cttcattgcagaaagagacatcgggaagattctgatgtggaaatggtggaagatgattcccgaaaggaaatgactgcagcttgtaccccccggagaaggatcattaacctcactagtgttt

SEQ ID NO: 3113 - DNA, 121 bp, Homo sapiens
aaacactagtgaggttaatgatccttctccggggggtacaagctgcagtcatttcctttcgggaatcatcttccaccatttccacatcagaatcttcccgatgtctctttctgcaatgaag

SEQ ID NO: 3114 - DNA, 17 bp, Homo sapiens
atgattcccgaaaggaa

SEQ ID NO: 3115 - DNA, 17 bp, Homo sapiens
ttcctttcgggaatcat

SEQ ID NO: 3116 - DNA, 121 bp, Homo sapiens
agacatcgggaagattctgatgtggaaatggtggaagatgattcccgaaaggaaatgactgcagcttgtaccccccggagaaggatcattaacctcactagtgttttgagtctccaggaag

SEQ ID NO: 3117 - DNA, 121 bp, Homo sapiens
cttcctggagactcaaaacactagtgaggttaatgatccttctccggggggtacaagctgcagtcatttcctttcgggaatcatcttccaccatttccacatcagaatcttcccgatgtct

SEQ ID NO: 3118 - DNA, 17 bp, Homo sapiens
aaatgactgcagcttgt

SEQ ID NO: 3119 - DNA, 17 bp, Homo sapiens
acaagctgcagtcattt

SEQ ID NO: 3120 - DNA, 121 bp, Homo sapiens
cccgaaaggaaatgactgcagcttgtaccccccggagaaggatcattaacctcactagtgttttgagtctccaggaagaaattaatgagcagggacatgagggtacgtaaacgctgtggcc

SEQ ID NO: 3121 - DNA, 121 bp, Homo sapiens
ggccacagcgtttacgtaccctcatgtccctgctcattaatttcttcctggagactcaaaacactagtgaggttaatgatccttctccggggggtacaagctgcagtcatttcctttcggg

SEQ ID NO: 3122 - DNA, 17 bp, Homo sapiens
cactagtgttttgagtc

SEQ ID NO: 3123 - DNA, 17 bp, Homo sapiens
gactcaaaacactagtg

SEQ ID NO: 3124 - DNA, 121 bp, Homo sapiens
gggagatgttgcataaccactccttcgtgggctgtgtgaatcctcagtgggccttggcacagcatcaaaccaagttataccttctcaacaccaccaagcttaggtaaatcagctgagtgtg

SEQ ID NO: 3125 - DNA, 121 bp, Homo sapiens
cacactcagctgatttacctaagcttggtggtgttgagaaggtataacttggtttgatgctgtgccaaggcccactgaggattcacacagcccacgaaggagtggttatgcaacatctccc

SEQ ID NO: 3126 - DNA, 17 bp, Homo sapiens
cttggcacagcatcaaa

SEQ ID NO: 3127 - DNA, 17 bp, Homo sapiens
tttgatgctgtgccaag

SEQ ID NO: 3128 - DNA, 121 bp, Homo sapiens
ccttcgtgggctgtgtgaatcctcagtgggccttggcacagcatcaaaccaagttataccttctcaacaccaccaagcttaggtaaatcagctgagtgtgtgaacaagcagagctactaca

SEQ ID NO: 3129 - DNA, 121 bp, Homo sapiens
tgtagtagctctgcttgttcacacactcagctgatttacctaagcttggtggtgttgagaaggtataacttggtttgatgctgtgccaaggcccactgaggattcacacagcccacgaagg

SEQ ID NO: 3130 - DNA, 17 bp, Homo sapiens
gttataccttctcaaca

SEQ ID NO: 3131 - DNA, 17 bp, Homo sapiens
tgttgagaaggtataac

SEQ ID NO: 3132 - DNA, 121 bp, Homo sapiens
tgggctgtgtgaatcctcagtgggccttggcacagcatcaaaccaagttataccttctcaacaccaccaagcttaggtaaatcagctgagtgtgtgaacaagcagagctactacaacaatg

SEQ ID NO: 3133 - DNA, 121 bp, Homo sapiens
cattgttgtagtagctctgcttgttcacacactcagctgatttacctaagcttggtggtgttgagaaggtataacttggtttgatgctgtgccaaggcccactgaggattcacacagccca

SEQ ID NO: 3134 - DNA, 17 bp, Homo sapiens
ccttctcaacaccacca

SEQ ID NO: 3135 - DNA, 17 bp, Homo sapiens
tggtggtgttgagaagg

SEQ ID NO: 3136 - DNA, 121 bp, Homo sapiens
atgaattcagcttttccttaaagtcacttcatttttattttcagtgaagaactgttctaccagatactcatttatgattttgccaattttggtgttctcaggttatcggtaagtttagatc

SEQ ID NO: 3137 - DNA, 121 bp, Homo sapiens
gatctaaacttaccgataacctgagaacaccaaaattggcaaaatcataaatgagtatctggtagaacagttcttcactgaaaataaaaatgaagtgactttaaggaaaagctgaattcat

SEQ ID NO: 3138 - DNA, 17 bp, Homo sapiens
tgttctaccagatactc

SEQ ID NO: 3139 - DNA, 17 bp, Homo sapiens
gagtatctggtagaaca

SEQ ID NO: 3140 - DNA, 121 bp, Homo sapiens
gcttttccttaaagtcacttcatttttattttcagtgaagaactgttctaccagatactcatttatgattttgccaattttggtgttctcaggttatcggtaagtttagatccttttcact

SEQ ID NO: 3141 - DNA, 121 bp, Homo sapiens
agtgaaaaggatctaaacttaccgataacctgagaacaccaaaattggcaaaatcataaatgagtatctggtagaacagttcttcactgaaaataaaaatgaagtgactttaaggaaaagc

SEQ ID NO: 3142 - DNA, 17 bp, Homo sapiens
agatactcatttatgat

SEQ ID NO: 3143 - DNA, 17 bp, Homo sapiens
atcataaatgagtatct

SEQ ID NO: 3144 - DNA, 121 bp, Homo sapiens
ttttcagtgaagaactgttctaccagatactcatttatgattttgccaattttggtgttctcaggttatcggtaagtttagatccttttcacttctgaaatttcaactgatcgtttctgaa

SEQ ID NO: 3145 - DNA, 121 bp, Homo sapiens
ttcagaaacgatcagttgaaatttcagaagtgaaaaggatctaaacttaccgataacctgagaacaccaaaattggcaaaatcataaatgagtatctggtagaacagttcttcactgaaaa

SEQ ID NO: 3146 - DNA, 17 bp, Homo sapiens
tggtgttctcaggttat

SEQ ID NO: 3147 - DNA, 17 bp, Homo sapiens
ataacctgagaacacca

SEQ ID NO: 3148 - DNA, 121 bp, Homo sapiens
tggatgctccgttaaagcttgctccttcatgttcttgcttcttcctaggagccagcaccgctctttgaccttgccatgcttgccttagatagtccagagagtggctggacagaggaagatg

SEQ ID NO: 3149 - DNA, 121 bp, Homo sapiens
catcttcctctgtccagccactctctggactatctaaggcaagcatggcaaggtcaaagagcggtgctggctcctaggaagaagcaagaacatgaaggagcaagctttaacggagcatcca

SEQ ID NO: 3150 - DNA, 17 bp, Homo sapiens
cagcaccgctctttgac

SEQ ID NO: 3151 - DNA, 17 bp, Homo sapiens
gtcaaagagcggtgctg

SEQ ID NO: 3152 - DNA, 121 bp, Homo sapiens
tgcttgccttagatagtccagagagtggctggacagaggaagatggtcccaaagaaggacttgctgaatacattgttgagtttctgaagaagaaggctgagatgcttgcagactatttctc

SEQ ID NO: 3153 - DNA, 121 bp, Homo sapiens
gagaaatagtctgcaagcatctcagccttcttcttcagaaactcaacaatgtattcagcaagtccttctttgggaccatcttcctctgtccagccactctctggactatctaaggcaagca

SEQ ID NO: 3154 - DNA, 17 bp, Homo sapiens
agaaggacttgctgaat

SEQ ID NO: 3155 - DNA, 17 bp, Homo sapiens
attcagcaagtccttct

SEQ ID NO: 3156 - DNA, 121 bp, Homo sapiens
acagaggaagatggtcccaaagaaggacttgctgaatacattgttgagtttctgaagaagaaggctgagatgcttgcagactatttctctttggaaattgatgaggtgtgacagccattct

SEQ ID NO: 3157 - DNA, 121 bp, Homo sapiens
agaatggctgtcacacctcatcaatttccaaagagaaatagtctgcaagcatctcagccttcttcttcagaaactcaacaatgtattcagcaagtccttctttgggaccatcttcctctgt

SEQ ID NO: 3158 - DNA, 17 bp, Homo sapiens
tgaagaagaaggctgag

SEQ ID NO: 3159 - DNA, 17 bp, Homo sapiens
ctcagccttcttcttca

SEQ ID NO: 3160 - DNA, 121 bp, Homo sapiens
cagaggaagatggtcccaaagaaggacttgctgaatacattgttgagtttctgaagaagaaggctgagatgcttgcagactatttctctttggaaattgatgaggtgtgacagccattctt

SEQ ID NO: 3161 - DNA, 121 bp, Homo sapiens
aagaatggctgtcacacctcatcaatttccaaagagaaatagtctgcaagcatctcagccttcttcttcagaaactcaacaatgtattcagcaagtccttctttgggaccatcttcctctg

SEQ ID NO: 3162 - DNA, 17 bp, Homo sapiens
gaagaagaaggctgaga

SEQ ID NO: 3163 - DNA, 17 bp, Homo sapiens
tctcagccttcttcttc

SEQ ID NO: 3164 - DNA, 121 bp, Homo sapiens
taccccttctgattgacaactatgtgccccctttggagggactgcctatcttcattcttcgactagccactgaggtcagtgatcaagcagatactaagcatttcggtacatgcatgtgtgc

SEQ ID NO: 3165 - DNA, 121 bp, Homo sapiens
gcacacatgcatgtaccgaaatgcttagtatctgcttgatcactgacctcagtggctagtcgaagaatgaagataggcagtccctccaaagggggcacatagttgtcaatcagaaggggta

SEQ ID NO: 3166 - DNA, 17 bp, Homo sapiens
cattcttcgactagcca

SEQ ID NO: 3167 - DNA, 17 bp, Homo sapiens
tggctagtcgaagaatg

SEQ ID NO: 3168 - DNA, 121 bp, Homo sapiens; identical to SEQ ID NO: 3164

SEQ ID NO: 3169 - DNA, 121 bp, Homo sapiens; identical to SEQ ID NO: 3165

SEQ ID NO: 3170 - DNA, 17 bp, Homo sapiens
cattcttcgactagcca

SEQ ID NO: 3171 - DNA, 17 bp, Homo sapiens
tggctagtcgaagaatg

SEQ ID NO: 3172 - DNA, 121 bp, Homo sapiens
ttaccccttctgattgacaactatgtgccccctttggagggactgcctatcttcattcttcgactagccactgaggtcagtgatcaagcagatactaagcatttcggtacatgcatgtgtg

SEQ ID NO: 3173 - DNA, 121 bp, Homo sapiens
cacacatgcatgtaccgaaatgcttagtatctgcttgatcactgacctcagtggctagtcgaagaatgaagataggcagtccctccaaagggggcacatagttgtcaatcagaaggggtaa

SEQ ID NO: 3174 - DNA, 17 bp, Homo sapiens
tcattcttcgactagcc

SEQ ID NO: 3175 - DNA, 17 bp, Homo sapiens
ggctagtcgaagaatga

SEQ ID NO: 3176 - DNA, 121 bp, Homo sapiens
ttggaccaggtgaattgggacgaagaaaaggaatgttttgaaagcctcagtaaagaatgcgctatgttctattccatccggaagcagtacatatctgaggagtcgaccctctcaggccagc

SEQ ID NO: 3177 - DNA, 121 bp, Homo sapiens
gctggcctgagagggtcgactcctcagatatgtactgcttccggatggaatagaacatagcgcattctttactgaggctttcaaaacattccttttcttcgtcccaattcacctggtccaa

SEQ ID NO: 3178 - DNA, 17 bp, Homo sapiens
aagaatgcgctatgttc

SEQ ID NO: 3179 - DNA, 17 bp, Homo sapiens
gaacatagcgcattctt

SEQ ID NO: 3180 - DNA, 121 bp, Homo sapiens
aggcttatgacatctaatgtgttttccagagtgaagtgcctggctccattccaaactcctggaagtggactgtggaacacattgtctataaagccttgcgctcacacattctgcctcctaa

SEQ ID NO: 3181 - DNA, 121 bp, Homo sapiens
ttaggaggcagaatgtgtgagcgcaaggctttatagacaatgtgttccacagtccacttccaggagtttggaatggagccaggcacttcactctggaaaacacattagatgtcataagcct

SEQ ID NO: 3182 - DNA, 17 bp, Homo sapiens
aaactcctggaagtgga

SEQ ID NO: 3183 - DNA, 17 bp, Homo sapiens
tccacttccaggagttt

SEQ ID NO: 3184 - DNA, 121 bp, Homo sapiens
atgacatctaatgtgttttccagagtgaagtgcctggctccattccaaactcctggaagtggactgtggaacacattgtctataaagccttgcgctcacacattctgcctcctaaacattt

SEQ ID NO: 3185 - DNA, 121 bp, Homo sapiens
aaatgtttaggaggcagaatgtgtgagcgcaaggctttatagacaatgtgttccacagtccacttccaggagtttggaatggagccaggcacttcactctggaaaacacattagatgtcat

SEQ ID NO: 3186 - DNA, 17 bp, Homo sapiens
ctggaagtggactgtgg

SEQ ID NO: 3187 - DNA, 17 bp, Homo sapiens
ccacagtccacttccag

SEQ ID NO: 3188 - DNA, 121 bp, Homo sapiens
tgacatctaatgtgttttccagagtgaagtgcctggctccattccaaactcctggaagtggactgtggaacacattgtctataaagccttgcgctcacacattctgcctcctaaacatttc

SEQ ID NO: 3189 - DNA, 121 bp, Homo sapiens
gaaatgtttaggaggcagaatgtgtgagcgcaaggctttatagacaatgtgttccacagtccacttccaggagtttggaatggagccaggcacttcactctggaaaacacattagatgtca

SEQ ID NO: 3190 - DNA, 17 bp, Homo sapiens
tggaagtggactgtgga

SEQ ID NO: 3191 - DNA, 17 bp, Homo sapiens
tccacagtccacttcca

SEQ ID NO: 3192 - DNA, 121 bp, Homo sapiens
atctaatgtgttttccagagtgaagtgcctggctccattccaaactcctggaagtggactgtggaacacattgtctataaagccttgcgctcacacattctgcctcctaaacatttcacag

SEQ ID NO: 3193 - DNA, 121 bp, Homo sapiens
ctgtgaaatgtttaggaggcagaatgtgtgagcgcaaggctttatagacaatgtgttccacagtccacttccaggagtttggaatggagccaggcacttcactctggaaaacacattagat

SEQ ID NO: 3194 - DNA, 17 bp, Homo sapiens
agtggactgtggaacac

SEQ ID NO: 3195 - DNA, 17 bp, Homo sapiens
gtgttccacagtccact

SEQ ID NO: 3196 - DNA, 121 bp, Homo sapiens
gagtgaagtgcctggctccattccaaactcctggaagtggactgtggaacacattgtctataaagccttgcgctcacacattctgcctcctaaacatttcacagaagatggaaatatcctg

SEQ ID NO: 3197 - DNA, 121 bp, Homo sapiens
caggatatttccatcttctgtgaaatgtttaggaggcagaatgtgtgagcgcaaggctttatagacaatgtgttccacagtccacttccaggagtttggaatggagccaggcacttcactc

SEQ ID NO: 3198 - DNA, 17 bp, Homo sapiens
attgtctataaagcctt

SEQ ID NO: 3199 - DNA, 17 bp, Homo sapiens
aaggctttatagacaat

SEQ ID NO: 3200 - DNA, 121 bp, Homo sapiens
ctaaacatttcacagaagatggaaatatcctgcagcttgctaacctgcctgatctatacaaagtctttgagaggtgttaaatatggttatttatgcactgtgggatgtgttcttctttctc

SEQ ID NO: 3201 - DNA, 121 bp, Homo sapiens
gagaaagaagaacacatcccacagtgcataaataaccatatttaacacctctcaaagactttgtatagatcaggcaggttagcaagctgcaggatatttccatcttctgtgaaatgtttag

SEQ ID NO: 3202 - DNA, 17 bp, Homo sapiens
tctatacaaagtctttg

SEQ ID NO: 3203 - DNA, 17 bp, Homo sapiens
caaagactttgtataga

SEQ ID NO: 3204 - DNA, 121 bp, Homo sapiens
acagaagatggaaatatcctgcagcttgctaacctgcctgatctatacaaagtctttgagaggtgttaaatatggttatttatgcactgtgggatgtgttcttctttctctgtattccgat

SEQ ID NO: 3205 - DNA, 121 bp, Homo sapiens
atcggaatacagagaaagaagaacacatcccacagtgcataaataaccatatttaacacctctcaaagactttgtatagatcaggcaggttagcaagctgcaggatatttccatcttctgt

SEQ ID NO: 3206 - DNA, 17 bp, Homo sapiens
tctttgagaggtgttaa

SEQ ID NO: 3207 - DNA, 17 bp, Homo sapiens
ttaacacctctcaaaga

SEQ ID NO: 3208 - DNA, 121 bp, Homo sapiens
ttttccacaaaagacatttatcaggacctcaaccggttgttgaaaggcaaaaagggagagcagatgaatagtgctgtattgccagaaatggagaatcaggtacatggattataaatgtgaa

SEQ ID NO: 3209 - DNA, 121 bp, Homo sapiens
ttcacatttataatccatgtacctgattctccatttctggcaatacagcactattcatctgctctccctttttgcctttcaacaaccggttgaggtcctgataaatgtcttttgtggaaaa

SEQ ID NO: 3210 - DNA, 17 bp, Homo sapiens
agggagagcagatgaat

SEQ ID NO: 3211 - DNA, 17 bp, Homo sapiens
attcatctgctctccct

SEQ ID NO: 3212 - DNA, 121 bp, Homo sapiens
tcatcactgtctgcggtaatcaagtttttagaactcttatcagatgattccaactttggacagtttgaactgactacttttgacttcagccagtatatgaaattggatattgcagcagtca

SEQ ID NO: 3213 - DNA, 121 bp, Homo sapiens
tgactgctgcaatatccaatttcatatactggctgaagtcaaaagtagtcagttcaaactgtccaaagttggaatcatctgataagagttctaaaaacttgattaccgcagacagtgatga

SEQ ID NO: 3214 - DNA, 17 bp, Homo sapiens
actttggacagtttgaa

SEQ ID NO: 3215 - DNA, 17 bp, Homo sapiens
ttcaaactgtccaaagt

SEQ ID NO: 3216 - DNA, 121 bp, Homo sapiens
aactttggacagtttgaactgactacttttgacttcagccagtatatgaaattggatattgcagcagtcagagcccttaacctttttcaggtaaaaaaaaaaaaaaaaaaaaaaaaaaagg

SEQ ID NO: 3217 - DNA, 121 bp, Homo sapiens
cctttttttttttttttttttttttttttacctgaaaaaggttaagggctctgactgctgcaatatccaatttcatatactggctgaagtcaaaagtagtcagttcaaactgtccaaagtt

SEQ ID NO: 3218 - DNA, 17 bp, Homo sapiens
tggatattgcagcagtc

SEQ ID NO: 3219 - DNA, 17 bp, Homo sapiens
gactgctgcaatatcca

SEQ ID NO: 3220 - DNA, 121 bp, Homo sapiens
agcttgccattctttctattttattttttgtttactagggttctgttgaagataccactggctctcagtctctggctgccttgctgaataagtgtaaaacccctcaaggacaaagacttgt

SEQ ID NO: 3221 - DNA, 121 bp, Homo sapiens
acaagtctttgtccttgaggggttttacacttattcagcaaggcagccagagactgagagccagtggtatcttcaacagaaccctagtaaacaaaaaataaaatagaaagaatggcaagct

SEQ ID NO: 3222 - DNA, 17 bp, Homo sapiens
taccactggctctcagt

SEQ ID NO: 3223 - DNA, 17 bp, Homo sapiens
actgagagccagtggta

SEQ ID NO: 3224 - DNA, 121 bp, Homo sapiens
ttgccattctttctattttattttttgtttactagggttctgttgaagataccactggctctcagtctctggctgccttgctgaataagtgtaaaacccctcaaggacaaagacttgttaa

SEQ ID NO: 3225 - DNA, 121 bp, Homo sapiens
ttaacaagtctttgtccttgaggggttttacacttattcagcaaggcagccagagactgagagccagtggtatcttcaacagaaccctagtaaacaaaaaataaaatagaaagaatggcaa

SEQ ID NO: 3226 - DNA, 17 bp, Homo sapiens
cactggctctcagtctc

SEQ ID NO: 3227 - DNA, 17 bp, Homo sapiens
gagactgagagccagtg

SEQ ID NO: 3228 - DNA, 121 bp, Homo sapiens
gtggaagcttttgtagaagatgcagaattgaggcagactttacaagaagatttacttcgtcgattcccagatcttaaccgacttgccaagaagtttcaaagacaagcagcaaacttacaag

SEQ ID NO: 3229 - DNA, 121 bp, Homo sapiens
cttgtaagtttgctgcttgtctttgaaacttcttggcaagtcggttaagatctgggaatcgacgaagtaaatcttcttgtaaagtctgcctcaattctgcatcttctacaaaagcttccac

SEQ ID NO: 3230 - DNA, 17 bp, Homo sapiens
tacttcgtcgattccca

SEQ ID NO: 3231 - DNA, 17 bp, Homo sapiens
tgggaatcgacgaagta

SEQ ID NO: 3232 - DNA, 121 bp, Homo sapiens
caagaagatttacttcgtcgattcccagatcttaaccgacttgccaagaagtttcaaagacaagcagcaaacttacaagattgttaccgactctatcagggtataaatcaactacctaatg

SEQ ID NO: 3233 - DNA, 121 bp, Homo sapiens
cattaggtagttgatttataccctgatagagtcggtaacaatcttgtaagtttgctgcttgtctttgaaacttcttggcaagtcggttaagatctgggaatcgacgaagtaaatcttcttg

SEQ ID NO: 3234 - DNA, 17 bp, Homo sapiens
ttcaaagacaagcagca

SEQ ID NO: 3235 - DNA, 17 bp, Homo sapiens
tgctgcttgtctttgaa

SEQ ID NO: 3236 - DNA, 121 bp, Homo sapiens
gatcttaaccgacttgccaagaagtttcaaagacaagcagcaaacttacaagattgttaccgactctatcagggtataaatcaactacctaatgttatacaggctctggaaaaacatgaag

SEQ ID NO: 3237 - DNA, 121 bp, Homo sapiens
cttcatgtttttccagagcctgtataacattaggtagttgatttataccctgatagagtcggtaacaatcttgtaagtttgctgcttgtctttgaaacttcttggcaagtcggttaagatc

SEQ ID NO: 3238 - DNA, 17 bp, Homo sapiens
attgttaccgactctat

SEQ ID NO: 3239 - DNA, 17 bp, Homo sapiens
atagagtcggtaacaat

SEQ ID NO: 3240 - DNA, 121 bp, Homo sapiens
gcaaacttacaagattgttaccgactctatcagggtataaatcaactacctaatgttatacaggctctggaaaaacatgaaggtaacaagtgattttgtttttttgttttccttcaactca

SEQ ID NO: 3241 - DNA, 121 bp, Homo sapiens
tgagttgaaggaaaacaaaaaaacaaaatcacttgttaccttcatgtttttccagagcctgtataacattaggtagttgatttataccctgatagagtcggtaacaatcttgtaagtttgc

SEQ ID NO: 3242 - DNA, 17 bp, Homo sapiens
atgttatacaggctctg

SEQ ID NO: 3243 - DNA, 17 bp, Homo sapiens
cagagcctgtataacat

SEQ ID NO: 3244 - DNA, 121 bp, Homo sapiens
tattctgtaaaatgagatctttttatttgtttgttttactactttcttttaggaaaacaccagaaattattgttggcagtttttgtgactcctcttactgatcttcgttctgacttctcca

SEQ ID NO: 3245 - DNA, 121 bp, Homo sapiens
tggagaagtcagaacgaagatcagtaagaggagtcacaaaaactgccaacaataatttctggtgttttcctaaaagaaagtagtaaaacaaacaaataaaaagatctcattttacagaata

SEQ ID NO: 3246 - DNA, 17 bp, Homo sapiens
gaaaacaccagaaatta

SEQ ID NO: 3247 - DNA, 17 bp, Homo sapiens
taatttctggtgttttc

SEQ ID NO: 3248 - DNA, 121 bp, Homo sapiens
ctcctcttactgatcttcgttctgacttctccaagtttcaggaaatgatagaaacaactttagatatggatcaggtatgcaatatactttttaatttaagcagtagttatttttaaaaagc

SEQ ID NO: 3249 - DNA, 121 bp, Homo sapiens
gctttttaaaaataactactgcttaaattaaaaagtatattgcatacctgatccatatctaaagttgtttctatcatttcctgaaacttggagaagtcagaacgaagatcagtaagaggag

SEQ ID NO: 3250 - DNA, 17 bp, Homo sapiens
aacaactttagatatgg

SEQ ID NO: 3251 - DNA, 17 bp, Homo sapiens
ccatatctaaagttgtt

SEQ ID NO: 3252 - DNA, 121 bp, Homo sapiens
tttcttcttgattatcaaggcttggaccctggcaaacagattaaactggattccagtgcacagtttggatattactttcgtgtaacctgtaaggaagaaaaagtccttcgtaacaataaaa

SEQ ID NO: 3253 - DNA, 121 bp, Homo sapiens
ttttattgttacgaaggactttttcttccttacaggttacacgaaagtaatatccaaactgtgcactggaatccagtttaatctgtttgccagggtccaagccttgataatcaagaagaaa

SEQ ID NO: 3254 - DNA, 17 bp, Homo sapiens
ccagtgcacagtttgga

SEQ ID NO: 3255 - DNA, 17 bp, Homo sapiens
tccaaactgtgcactgg

SEQ ID NO: 3256 - DNA, 121 bp, Homo sapiens
gcttggaccctggcaaacagattaaactggattccagtgcacagtttggatattactttcgtgtaacctgtaaggaagaaaaagtccttcgtaacaataaaaactttagtactgtagatat

SEQ ID NO: 3257 - DNA, 121 bp, Homo sapiens
atatctacagtactaaagtttttattgttacgaaggactttttcttccttacaggttacacgaaagtaatatccaaactgtgcactggaatccagtttaatctgtttgccagggtccaagc

SEQ ID NO: 3258 - DNA, 17 bp, Homo sapiens
ttactttcgtgtaacct

SEQ ID NO: 3259 - DNA, 17 bp, Homo sapiens
aggttacacgaaagtaa

SEQ ID NO: 3260 - DNA, 121 bp, Homo sapiens
ttaatatttttaataaaactgttatttcgatttgcagcaaattgacttctttaaatgaagagtataccaaaaataaaacagaatatgaagaagcccaggatgccattgttaaagaaattgt

SEQ ID NO: 3261 - DNA, 121 bp, Homo sapiens
acaatttctttaacaatggcatcctgggcttcttcatattctgttttatttttggtatactcttcatttaaagaagtcaatttgctgcaaatcgaaataacagttttattaaaaatattaa

SEQ ID NO: 3262 - DNA, 17 bp, Homo sapiens
aaatgaagagtatacca

SEQ ID NO: 3263 - DNA, 17 bp, Homo sapiens
tggtatactcttcattt

SEQ ID NO: 3264 - DNA, 121 bp, Homo sapiens
aatgaagagtataccaaaaataaaacagaatatgaagaagcccaggatgccattgttaaagaaattgtcaatatttcttcaggtaaacttaatagaactaataatgttctgaatgtcacct

SEQ ID NO: 3265 - DNA, 121 bp, Homo sapiens
aggtgacattcagaacattattagttctattaagtttacctgaagaaatattgacaatttctttaacaatggcatcctgggcttcttcatattctgttttatttttggtatactcttcatt

SEQ ID NO: 3266 - DNA, 17 bp, Homo sapiens
ttgttaaagaaattgtc

SEQ ID NO: 3267 - DNA, 17 bp, Homo sapiens
gacaatttctttaacaa

SEQ ID NO: 3268 - DNA, 121 bp, Homo sapiens
tgtttttatttttatacaggctatgtagaaccaatgcagacactcaatgatgtgttagctcagctagatgctgttgtcagctttgctcacgtgtcaaatggagcacctgttccatatgtac

SEQ ID NO: 3269 - DNA, 121 bp, Homo sapiens
gtacatatggaacaggtgctccatttgacacgtgagcaaagctgacaacagcatctagctgagctaacacatcattgagtgtctgcattggttctacatagcctgtataaaaataaaaaca

SEQ ID NO: 3270 - DNA, 17 bp, Homo sapiens
tgttagctcagctagat

SEQ ID NO: 3271 - DNA, 17 bp, Homo sapiens
atctagctgagctaaca

SEQ ID NO: 3272 - DNA, 121 bp, Homo sapiens
agctcagctagatgctgttgtcagctttgctcacgtgtcaaatggagcacctgttccatatgtacgaccagccattttggagaaaggacaaggaagaattatattaaaagcatccaggcat

SEQ ID NO: 3273 - DNA, 121 bp, Homo sapiens
atgcctggatgcttttaatataattcttccttgtcctttctccaaaatggctggtcgtacatatggaacaggtgctccatttgacacgtgagcaaagctgacaacagcatctagctgagct

SEQ ID NO: 3274 - DNA, 17 bp, Homo sapiens
gttccatatgtacgacc

SEQ ID NO: 3275 - DNA, 17 bp, Homo sapiens
ggtcgtacatatggaac

SEQ ID NO: 3276 - DNA, 121 bp, Homo sapiens
cagctagatgctgttgtcagctttgctcacgtgtcaaatggagcacctgttccatatgtacgaccagccattttggagaaaggacaaggaagaattatattaaaagcatccaggcatgctt

SEQ ID NO: 3277 - DNA, 121 bp, Homo sapiens
aagcatgcctggatgcttttaatataattcttccttgtcctttctccaaaatggctggtcgtacatatggaacaggtgctccatttgacacgtgagcaaagctgacaacagcatctagctg

SEQ ID NO: 3278 - DNA, 17 bp, Homo sapiens
catatgtacgaccagcc

SEQ ID NO: 3279 - DNA, 17 bp, Homo sapiens
ggctggtcgtacatatg

SEQ ID NO: 3280 - DNA, 121 bp, Homo sapiens
tagatgctgttgtcagctttgctcacgtgtcaaatggagcacctgttccatatgtacgaccagccattttggagaaaggacaaggaagaattatattaaaagcatccaggcatgcttgtgt

SEQ ID NO: 3281 - DNA, 121 bp, Homo sapiens
acacaagcatgcctggatgcttttaatataattcttccttgtcctttctccaaaatggctggtcgtacatatggaacaggtgctccatttgacacgtgagcaaagctgacaacagcatcta

SEQ ID NO: 3282 - DNA, 17 bp, Homo sapiens
tgtacgaccagccattt

SEQ ID NO: 3283 - DNA, 17 bp, Homo sapiens
aaatggctggtcgtaca

SEQ ID NO: 3284 - DNA, 121 bp, Homo sapiens
cctgttccatatgtacgaccagccattttggagaaaggacaaggaagaattatattaaaagcatccaggcatgcttgtgttgaagttcaagatgaaattgcatttattcctaatgacgtat

SEQ ID NO: 3285 - DNA, 121 bp, Homo sapiens
atacgtcattaggaataaatgcaatttcatcttgaacttcaacacaagcatgcctggatgcttttaatataattcttccttgtcctttctccaaaatggctggtcgtacatatggaacagg

SEQ ID NO: 3286 - DNA, 17 bp, Homo sapiens
tattaaaagcatccagg

SEQ ID NO: 3287 - DNA, 17 bp, Homo sapiens
cctggatgcttttaata

SEQ ID NO: 3288 - DNA, 121 bp, Homo sapiens
atgtacgaccagccattttggagaaaggacaaggaagaattatattaaaagcatccaggcatgcttgtgttgaagttcaagatgaaattgcatttattcctaatgacgtatactttgaaaa

SEQ ID NO: 3289 - DNA, 121 bp, Homo sapiens
ttttcaaagtatacgtcattaggaataaatgcaatttcatcttgaacttcaacacaagcatgcctggatgcttttaatataattcttccttgtcctttctccaaaatggctggtcgtacat

SEQ ID NO: 3290 - DNA, 17 bp, Homo sapiens
atccaggcatgcttgtg

SEQ ID NO: 3291 - DNA, 17 bp, Homo sapiens
cacaagcatgcctggat

SEQ ID NO: 3292 - DNA, 121 bp, Homo sapiens
tatgtacgaccagccattttggagaaaggacaaggaagaattatattaaaagcatccaggcatgcttgtgttgaagttcaagatgaaattgcatttattcctaatgacgtatactttgaaa

SEQ ID NO: 3293 - DNA, 121 bp, Homo sapiens
tttcaaagtatacgtcattaggaataaatgcaatttcatcttgaacttcaacacaagcatgcctggatgcttttaatataattcttccttgtcctttctccaaaatggctggtcgtacata

SEQ ID NO: 3294 - DNA, 17 bp, Homo sapiens
catccaggcatgcttgt

SEQ ID NO: 3295 - DNA, 17 bp, Homo sapiens
acaagcatgcctggatg

SEQ ID NO: 3296 - DNA, 121 bp, Homo sapiens
aaaggacaaggaagaattatattaaaagcatccaggcatgcttgtgttgaagttcaagatgaaattgcatttattcctaatgacgtatactttgaaaaagataaacagatgttccacatca

SEQ ID NO: 3297 - DNA, 121 bp, Homo sapiens
tgatgtggaacatctgtttatctttttcaaagtatacgtcattaggaataaatgcaatttcatcttgaacttcaacacaagcatgcctggatgcttttaatataattcttccttgtccttt

SEQ ID NO: 3298 - DNA, 17 bp, Homo sapiens
ttcaagatgaaattgca

SEQ ID NO: 3299 - DNA, 17 bp, Homo sapiens
tgcaatttcatcttgaa

SEQ ID NO: 3300 - DNA, 121 bp, Homo sapiens
atccaggcatgcttgtgttgaagttcaagatgaaattgcatttattcctaatgacgtatactttgaaaaagataaacagatgttccacatcattactggtaaaaaacctggtttttgggct

SEQ ID NO: 3301 - DNA, 121 bp, Homo sapiens
agcccaaaaaccaggttttttaccagtaatgatgtggaacatctgtttatctttttcaaagtatacgtcattaggaataaatgcaatttcatcttgaacttcaacacaagcatgcctggat

SEQ ID NO: 3302 - DNA, 17 bp, Homo sapiens
gacgtatactttgaaaa

SEQ ID NO: 3303 - DNA, 17 bp, Homo sapiens
ttttcaaagtatacgtc

SEQ ID NO: 3304 - DNA, 121 bp, Homo sapiens
gaaagaagtttaaaatcttgctttctgatataatttgttttgtaggccccaatatgggaggtaaatcaacatatattcgacaaactggggtgatagtactcatggcccaaattgggtgttt

SEQ ID NO: 3305 - DNA, 121 bp, Homo sapiens
aaacacccaatttgggccatgagtactatcaccccagtttgtcgaatatatgttgatttacctcccatattggggcctacaaaacaaattatatcagaaagcaagattttaaacttctttc

SEQ ID NO: 3306 - DNA, 17 bp, Homo sapiens
tatgggaggtaaatcaa

SEQ ID NO: 3307 - DNA, 17 bp, Homo sapiens
ttgatttacctcccata

SEQ ID NO: 3308 - DNA, 121 bp, Homo sapiens
ttgctttctgatataatttgttttgtaggccccaatatgggaggtaaatcaacatatattcgacaaactggggtgatagtactcatggcccaaattgggtgttttgtgccatgtgagtcag

SEQ ID NO: 3309 - DNA, 121 bp, Homo sapiens
ctgactcacatggcacaaaacacccaatttgggccatgagtactatcaccccagtttgtcgaatatatgttgatttacctcccatattggggcctacaaaacaaattatatcagaaagcaa

SEQ ID NO: 3310 - DNA, 17 bp, Homo sapiens
catatattcgacaaact

SEQ ID NO: 3311 - DNA, 17 bp, Homo sapiens
agtttgtcgaatatatg

SEQ ID NO: 3312 - DNA, 121 bp, Homo sapiens
atgggaggtaaatcaacatatattcgacaaactggggtgatagtactcatggcccaaattgggtgttttgtgccatgtgagtcagcagaagtgtccattgtggactgcatcttagcccgag

SEQ ID NO: 3313 - DNA, 121 bp, Homo sapiens
ctcgggctaagatgcagtccacaatggacacttctgctgactcacatggcacaaaacacccaatttgggccatgagtactatcaccccagtttgtcgaatatatgttgatttacctcccat

SEQ ID NO: 3314 - DNA, 17 bp, Homo sapiens
cccaaattgggtgtttt

SEQ ID NO: 3315 - DNA, 17 bp, Homo sapiens
aaaacacccaatttggg

SEQ ID NO: 3316 - DNA, 121 bp, Homo sapiens
acatatattcgacaaactggggtgatagtactcatggcccaaattgggtgttttgtgccatgtgagtcagcagaagtgtccattgtggactgcatcttagcccgagtaggggctggtgaca

SEQ ID NO: 3317 - DNA, 121 bp, Homo sapiens
tgtcaccagcccctactcgggctaagatgcagtccacaatggacacttctgctgactcacatggcacaaaacacccaatttgggccatgagtactatcaccccagtttgtcgaatatatgt

SEQ ID NO: 3318 - DNA, 17 bp, Homo sapiens
ttgtgccatgtgagtca

SEQ ID NO: 3319 - DNA, 17 bp, Homo sapiens
tgactcacatggcacaa

SEQ ID NO: 3320 - DNA, 121 bp, Homo sapiens
catatattcgacaaactggggtgatagtactcatggcccaaattgggtgttttgtgccatgtgagtcagcagaagtgtccattgtggactgcatcttagcccgagtaggggctggtgacag

SEQ ID NO: 3321 - DNA, 121 bp, Homo sapiens
ctgtcaccagcccctactcgggctaagatgcagtccacaatggacacttctgctgactcacatggcacaaaacacccaatttgggccatgagtactatcaccccagtttgtcgaatatatg

SEQ ID NO: 3322 - DNA, 17 bp, Homo sapiens
tgtgccatgtgagtcag

SEQ ID NO: 3323 - DNA, 17 bp, Homo sapiens
ctgactcacatggcaca

SEQ ID NO: 3324 - DNA, 121 bp, Homo sapiens
gagtcagcagaagtgtccattgtggactgcatcttagcccgagtaggggctggtgacagtcaattgaaaggagtctccacgttcatggctgaaatgttggaaactgcttctatcctcaggt

SEQ ID NO: 3325 - DNA, 121 bp, Homo sapiens
acctgaggatagaagcagtttccaacatttcagccatgaacgtggagactcctttcaattgactgtcaccagcccctactcgggctaagatgcagtccacaatggacacttctgctgactc

SEQ ID NO: 3326 - DNA, 17 bp, Homo sapiens
gtgacagtcaattgaaa

SEQ ID NO: 3327 - DNA, 17 bp, Homo sapiens
tttcaattgactgtcac

SEQ ID NO: 3328 - DNA, 121 bp, Homo sapiens
ccaatcagataccaactgttaataatctacatgtcacagcactcaccactgaagagaccttaactatgctttatcaggtgaagaaaggtatgtactattggagtactctaaattcagaact

SEQ ID NO: 3329 - DNA, 121 bp, Homo sapiens
agttctgaatttagagtactccaatagtacatacctttcttcacctgataaagcatagttaaggtctcttcagtggtgagtgctgtgacatgtagattattaacagttggtatctgattgg

SEQ ID NO: 3330 - DNA, 17 bp, Homo sapiens
agagaccttaactatgc

SEQ ID NO: 3331 - DNA, 17 bp, Homo sapiens
gcatagttaaggtctct

SEQ ID NO: 3332 - DNA, 121 bp, Homo sapiens
ttccccaaatttcttataggtgtctgtgatcaaagttttgggattcatgttgcagagcttgctaatttccctaagcatgtaatagagtgtgctaaacagaaagccctggaacttgaggagt

SEQ ID NO: 3333 - DNA, 121 bp, Homo sapiens
actcctcaagttccagggctttctgtttagcacactctattacatgcttagggaaattagcaagctctgcaacatgaatcccaaaactttgatcacagacacctataagaaatttggggaa

SEQ ID NO: 3334 - DNA, 17 bp, Homo sapiens
cagagcttgctaatttc

SEQ ID NO: 3335 - DNA, 17 bp, Homo sapiens
gaaattagcaagctctg

SEQ ID NO: 3336 - DNA, 121 bp, Homo sapiens
atagagtgtgctaaacagaaagccctggaacttgaggagtttcagtatattggagaatcgcaaggatatgatatcatggaaccagcagcaaagaagtgctatctggaaagagaggtttgtc

SEQ ID NO: 3337 - DNA, 121 bp, Homo sapiens
gacaaacctctctttccagatagcacttctttgctgctggttccatgatatcatatccttgcgattctccaatatactgaaactcctcaagttccagggctttctgtttagcacactctat

SEQ ID NO: 3338 - DNA, 17 bp, Homo sapiens
gagaatcgcaaggatat

SEQ ID NO: 3339 - DNA, 17 bp, Homo sapiens
atatccttgcgattctc

SEQ ID NO: 3340 - DNA, 121 bp, Homo sapiens
aggagttcctgtccaaggtgaaacaaatgccctttactgaaatgtcagaagaaaacatcacaataaagttaaaacagctaaaagctgaagtaatagcaaagaataatagctttgtaaatga

SEQ ID NO: 3341 - DNA, 121 bp, Homo sapiens
tcatttacaaagctattattctttgctattacttcagcttttagctgttttaactttattgtgatgttttcttctgacatttcagtaaagggcatttgtttcaccttggacaggaactcct

SEQ ID NO: 3342 - DNA, 17 bp, Homo sapiens
aaacatcacaataaagt

SEQ ID NO: 3343 - DNA, 17 bp, Homo sapiens
actttattgtgatgttt

SEQ ID NO: 3344 - DNA, 121 bp, Homo sapiens
ggaaatcagtccgtgttcatgtacagttttttgatgacagcccaacaaggggctgggttagcaaaaggcttttaaagccatatacaggtaagagtcactactgccatgtgtgtgtgtttgt

SEQ ID NO: 3345 - DNA, 121 bp, Homo sapiens
acaaacacacacacatggcagtagtgactcttacctgtatatggctttaaaagccttttgctaacccagccccttgttgggctgtcatcaaaaaactgtacatgaacacggactgatttcc

SEQ ID NO: 3346 - DNA, 17 bp, Homo sapiens
ctgggttagcaaaaggc

SEQ ID NO: 3347 - DNA, 17 bp, Homo sapiens
gccttttgctaacccag

SEQ ID NO: 3348 - DNA, 121 bp, Homo sapiens
cgtgagcctctgcacccggcccttattgtttataaatacatttctttctaggttcaaaatcaaaggaagcccagaagggaggtcatttttacagtgcaaagcctgaaatactgagagcaat

SEQ ID NO: 3349 - DNA, 121 bp, Homo sapiens
attgctctcagtatttcaggctttgcactgtaaaaatgacctcccttctgggcttcctttgattttgaacctagaaagaaatgtatttataaacaataagggccgggtgcagaggctcacg

SEQ ID NO: 3350 - DNA, 17 bp, Homo sapiens
ttcaaaatcaaaggaag

SEQ ID NO: 3351 - DNA, 17 bp, Homo sapiens
cttcctttgattttgaa

SEQ ID NO: 3352 - DNA, 121 bp, Homo sapiens
ttccaaattttgatttgtttttaaatactctttccttgcctggcaggtaggcacaacttacgtaacagataagagtgaagaagataatgaaattgagagtgaagaggaagtacagcctaag

SEQ ID NO: 3353 - DNA, 121 bp, Homo sapiens
cttaggctgtacttcctcttcactctcaatttcattatcttcttcactcttatctgttacgtaagttgtgcctacctgccaggcaaggaaagagtatttaaaaacaaatcaaaatttggaa

SEQ ID NO: 3354 - DNA, 17 bp, Homo sapiens
acaacttacgtaacaga

SEQ ID NO: 3355 - DNA, 17 bp, Homo sapiens
tctgttacgtaagttgt

SEQ ID NO: 3356 - DNA, 121 bp, Homo sapiens
gaagaggaagtacagcctaagacacaaggatctaggcgaagtagccgccaaataaaaaaacgaagggtcatatcagattctgagagtgacattggtggctctgatgtggaatttaagccag

SEQ ID NO: 3357 - DNA, 121 bp, Homo sapiens
ctggcttaaattccacatcagagccaccaatgtcactctcagaatctgatatgacccttcgtttttttatttggcggctacttcgcctagatccttgtgtcttaggctgtacttcctcttc

SEQ ID NO: 3358 - DNA, 17 bp, Homo sapiens
taaaaaaacgaagggtc

SEQ ID NO: 3359 - DNA, 17 bp, Homo sapiens
gacccttcgttttttta

SEQ ID NO: 3360 - DNA, 121 bp, Homo sapiens
ttaagccagacactaaggaggaaggaagcagtgatgaaataagcagtggagtgggggatagtgagagtgaaggcctgaacagccctgtcaaagttgctcgaaagcggaagagaatggtgac

SEQ ID NO: 3361 - DNA, 121 bp, Homo sapiens
gtcaccattctcttccgctttcgagcaactttgacagggctgttcaggccttcactctcactatcccccactccactgcttatttcatcactgcttccttcctccttagtgtctggcttaa

SEQ ID NO: 3362 - DNA, 17 bp, Homo sapiens
gggggatagtgagagtg

SEQ ID NO: 3363 - DNA, 17 bp, Homo sapiens
cactctcactatccccc

SEQ ID NO: 3364 - DNA, 121 bp, Homo sapiens
gaggaagattcttctggccatactcgtgcatatggtgtgtgctttgttgatacttcactgggaaagtttttcataggtcagttttcagatgatcgccattgttcgagatttaggactctag

SEQ ID NO: 3365 - DNA, 121 bp, Homo sapiens
ctagagtcctaaatctcgaacaatggcgatcatctgaaaactgacctatgaaaaactttcccagtgaagtatcaacaaagcacacaccatatgcacgagtatggccagaagaatcttcctc

SEQ ID NO: 3366 - DNA, 17 bp, Homo sapiens
cttcactgggaaagttt

SEQ ID NO: 3367 - DNA, 17 bp, Homo sapiens
aaactttcccagtgaag

SEQ ID NO: 3368 - DNA, 121 bp, Homo sapiens
gaattggccctctctgctctaggtggttgtgtcttctacctcaaaaaatgccttattgatcaggagcttttatcaatggctaattttgaagaatatattcccttggattctgacacagtca

SEQ ID NO: 3369 - DNA, 121 bp, Homo sapiens
tgactgtgtcagaatccaagggaatatattcttcaaaattagccattgataaaagctcctgatcaataaggcattttttgaggtagaagacacaaccacctagagcagagagggccaattc

SEQ ID NO: 3370 - DNA, 17 bp, Homo sapiens
ttattgatcaggagctt

SEQ ID NO: 3371 - DNA, 17 bp, Homo sapiens
aagctcctgatcaataa

SEQ ID NO: 3372 - DNA, 121 bp, Homo sapiens
cccttggattctgacacagtcagcactacaagatctggtgctatcttcaccaaagcctatcaacgaatggtgctagatgcagtgacattaaacaacttggagatttttctgaatggaacaa

SEQ ID NO: 3373 - DNA, 121 bp, Homo sapiens
ttgttccattcagaaaaatctccaagttgtttaatgtcactgcatctagcaccattcgttgataggctttggtgaagatagcaccagatcttgtagtgctgactgtgtcagaatccaaggg

SEQ ID NO: 3374 - DNA, 17 bp, Homo sapiens
aagcctatcaacgaatg

SEQ ID NO: 3375 - DNA, 17 bp, Homo sapiens
cattcgttgataggctt

SEQ ID NO: 3376 - DNA, 121 bp, Homo sapiens
gccccactctgtaaccattatgctattaatgatcgtctagatgccatagaagacctcatggttgtgcctgacaaaatctccgaagttgtagagcttctaaagaagcttccagatcttgaga

SEQ ID NO: 3377 - DNA, 121 bp, Homo sapiens
tctcaagatctggaagcttctttagaagctctacaacttcggagattttgtcaggcacaaccatgaggtcttctatggcatctagacgatcattaatagcataatggttacagagtggggc

SEQ ID NO: 3378 - DNA, 17 bp, Homo sapiens
acctcatggttgtgcct

SEQ ID NO: 3379 - DNA, 17 bp, Homo sapiens
aggcacaaccatgaggt

SEQ ID NO: 3380 - DNA, 121 bp, Homo sapiens
gtaaccattatgctattaatgatcgtctagatgccatagaagacctcatggttgtgcctgacaaaatctccgaagttgtagagcttctaaagaagcttccagatcttgagaggctactcag

SEQ ID NO: 3381 - DNA, 121 bp, Homo sapiens
ctgagtagcctctcaagatctggaagcttctttagaagctctacaacttcggagattttgtcaggcacaaccatgaggtcttctatggcatctagacgatcattaatagcataatggttac

SEQ ID NO: 3382 - DNA, 17 bp, Homo sapiens
tgtgcctgacaaaatct

SEQ ID NO: 3383 - DNA, 17 bp, Homo sapiens
agattttgtcaggcaca

SEQ ID NO: 3384 - DNA, 121 bp, Homo sapiens
ctcccctgaagagtcagaaccacccagacagcagggctataatgtatgaagaaactacatacagcaagaagaagattattgattttctttctgctctggaaggattcaaagtaatgtgtaa

SEQ ID NO: 3385 - DNA, 121 bp, Homo sapiens
ttacacattactttgaatccttccagagcagaaagaaaatcaataatcttcttcttgctgtatgtagtttcttcatacattatagccctgctgtctgggtggttctgactcttcaggggag

SEQ ID NO: 3386 - DNA, 17 bp, Homo sapiens
aactacatacagcaaga

SEQ ID NO: 3387 - DNA, 17 bp, Homo sapiens
tcttgctgtatgtagtt

SEQ ID NO: 3388 - DNA, 121 bp, Homo sapiens
tatagtcgagggggtgatggtcctatgtgtcgcccagtaattctgttgccggaagataccccccccttcttagagcttaaaggatcacgccatccttgcattacgaagactttttttggag

SEQ ID NO: 3389 - DNA, 121 bp, Homo sapiens
ctccaaaaaaagtcttcgtaatgcaaggatggcgtgatcctttaagctctaagaaggggggggtatcttccggcaacagaattactgggcgacacataggaccatcaccccctcgactata

SEQ ID NO: 3390 - DNA, 17 bp, Homo sapiens
aagataccccccccttc

SEQ ID NO: 3391 - DNA, 17 bp, Homo sapiens
gaaggggggggtatctt

SEQ ID NO: 3392 - DNA, 121 bp, Homo sapiens
actataaaatgtcgtacattattttcaactcactaccattcattagtagaagattattctcaaaatgttgctgtgcgcctaggacatatggtatgtgcaaattgtttttttccacaaattc

SEQ ID NO: 3393 - DNA, 121 bp, Homo sapiens
gaatttgtggaaaaaaacaatttgcacataccatatgtcctaggcgcacagcaacattttgagaataatcttctactaatgaatggtagtgagttgaaaataatgtacgacattttatagt

SEQ ID NO: 3394 - DNA, 17 bp, Homo sapiens
attattctcaaaatgtt

SEQ ID NO: 3395 - DNA, 17 bp, Homo sapiens
aacattttgagaataat

SEQ ID NO: 3396 - DNA, 121 bp, Homo sapiens
ttgttccacacaggatgccaggccaaggtggagcaagcggtggagacagagccggagcccgagctgcgccagcagaccgagtggcagagcggccagcgctgggaactggcactgggtcgct

SEQ ID NO: 3397 - DNA, 121 bp, Homo sapiens
agcgacccagtgccagttcccagcgctggccgctctgccactcggtctgctggcgcagctcgggctccggctctgtctccaccgcttgctccaccttggcctggcatcctgtgtggaacaa

SEQ ID NO: 3398 - DNA, 17 bp, Homo sapiens
cggagcccgagctgcgc

SEQ ID NO: 3399 - DNA, 17 bp, Homo sapiens
gcgcagctcgggctccg

SEQ ID NO: 3400 - DNA, 121 bp, Homo sapiens
caaggtggagcaagcggtggagacagagccggagcccgagctgcgccagcagaccgagtggcagagcggccagcgctgggaactggcactgggtcgcttttgggattacctgcgctgggtg

SEQ ID NO: 3401 - DNA, 121 bp, Homo sapiens
cacccagcgcaggtaatcccaaaagcgacccagtgccagttcccagcgctggccgctctgccactcggtctgctggcgcagctcgggctccggctctgtctccaccgcttgctccaccttg

SEQ ID NO: 3402 - DNA, 17 bp, Homo sapiens
accgagtggcagagcgg

SEQ ID NO: 3403 - DNA, 17 bp, Homo sapiens
ccgctctgccactcggt

SEQ ID NO: 3404 - DNA, 121 bp, Homo sapiens
cagagccggagcccgagctgcgccagcagaccgagtggcagagcggccagcgctgggaactggcactgggtcgcttttgggattacctgcgctgggtgcagacactgtctgagcaggtgca

SEQ ID NO: 3405 - DNA, 121 bp, Homo sapiens
tgcacctgctcagacagtgtctgcacccagcgcaggtaatcccaaaagcgacccagtgccagttcccagcgctggccgctctgccactcggtctgctggcgcagctcgggctccggctctg

SEQ ID NO: 3406 - DNA, 17 bp, Homo sapiens
ctgggaactggcactgg

SEQ ID NO: 3407 - DNA, 17 bp, Homo sapiens
ccagtgccagttcccag

SEQ ID NO: 3408 - DNA, 121 bp, Homo sapiens
cggctgtccaaggagctgcaggcggcgcaggcccggctgggcgcggacatggaggacgtgtgcggccgcctggtgcagtaccgcggcgaggtgcaggccatgctcggccagagcaccgagg

SEQ ID NO: 3409 - DNA, 121 bp, Homo sapiens
cctcggtgctctggccgagcatggcctgcacctcgccgcggtactgcaccaggcggccgcacacgtcctccatgtccgcgcccagccgggcctgcgccgcctgcagctccttggacagccg

SEQ ID NO: 3410 - DNA, 17 bp, Homo sapiens
aggacgtgtgcggccgc

SEQ ID NO: 3411 - DNA, 17 bp, Homo sapiens
gcggccgcacacgtcct

SEQ ID NO: 3412 - DNA, 121 bp, Homo sapiens
acatggaggacgtgtgcggccgcctggtgcagtaccgcggcgaggtgcaggccatgctcggccagagcaccgaggagctgcgggtgcgcctcgcctcccacctgcgcaagctgcgtaagcg

SEQ ID NO: 3413 - DNA, 121 bp, Homo sapiens
cgcttacgcagcttgcgcaggtgggaggcgaggcgcacccgcagctcctcggtgctctggccgagcatggcctgcacctcgccgcggtactgcaccaggcggccgcacacgtcctccatgt

SEQ ID NO: 3414 - DNA, 17 bp, Homo sapiens
catgctcggccagagca

SEQ ID NO: 3415 - DNA, 17 bp, Homo sapiens
tgctctggccgagcatg

SEQ ID NO: 3416 - DNA, 121 bp, Homo sapiens
gtgcagtaccgcggcgaggtgcaggccatgctcggccagagcaccgaggagctgcgggtgcgcctcgcctcccacctgcgcaagctgcgtaagcggctcctccgcgatgccgatgacctgc

SEQ ID NO: 3417 - DNA, 121 bp, Homo sapiens
gcaggtcatcggcatcgcggaggagccgcttacgcagcttgcgcaggtgggaggcgaggcgcacccgcagctcctcggtgctctggccgagcatggcctgcacctcgccgcggtactgcac

SEQ ID NO: 3418 - DNA, 17 bp, Homo sapiens
tgcgggtgcgcctcgcc

SEQ ID NO: 3419 - DNA, 17 bp, Homo sapiens
ggcgaggcgcacccgca

SEQ ID NO: 3420 - DNA, 121 bp, Homo sapiens
tgcagtaccgcggcgaggtgcaggccatgctcggccagagcaccgaggagctgcgggtgcgcctcgcctcccacctgcgcaagctgcgtaagcggctcctccgcgatgccgatgacctgca

SEQ ID NO: 3421 - DNA, 121 bp, Homo sapiens
tgcaggtcatcggcatcgcggaggagccgcttacgcagcttgcgcaggtgggaggcgaggcgcacccgcagctcctcggtgctctggccgagcatggcctgcacctcgccgcggtactgca

SEQ ID NO: 3422 - DNA, 17 bp, Homo sapiens
gcgggtgcgcctcgcct

SEQ ID NO: 3423 - DNA, 17 bp, Homo sapiens
aggcgaggcgcacccgc

SEQ ID NO: 3424 - DNA, 121 bp, Homo sapiens; identical to SEQ ID NO: 3416

SEQ ID NO: 3425 - DNA, 121 bp, Homo sapiens; identical to SEQ ID NO: 3417

SEQ ID NO: 3426 - DNA, 17 bp, Homo sapiens
tgcgggtgcgcctcgcc

SEQ ID NO: 3427 - DNA, 17 bp, Homo sapiens
ggcgaggcgcacccgca

SEQ ID NO: 3428 - DNA, 121 bp, Homo sapiens
gtgcaggccatgctcggccagagcaccgaggagctgcgggtgcgcctcgcctcccacctgcgcaagctgcgtaagcggctcctccgcgatgccgatgacctgcagaagcgcctggcagtgt

SEQ ID NO: 3429 - DNA, 121 bp, Homo sapiens
acactgccaggcgcttctgcaggtcatcggcatcgcggaggagccgcttacgcagcttgcgcaggtgggaggcgaggcgcacccgcagctcctcggtgctctggccgagcatggcctgcac

SEQ ID NO: 3430 - DNA, 17 bp, Homo sapiens
cccacctgcgcaagctg

SEQ ID NO: 3431 - DNA, 17 bp, Homo sapiens
cagcttgcgcaggtggg

SEQ ID NO: 3432 - DNA, 121 bp, Homo sapiens
tgcaggccatgctcggccagagcaccgaggagctgcgggtgcgcctcgcctcccacctgcgcaagctgcgtaagcggctcctccgcgatgccgatgacctgcagaagcgcctggcagtgta

SEQ ID NO: 3433 - DNA, 121 bp, Homo sapiens
tacactgccaggcgcttctgcaggtcatcggcatcgcggaggagccgcttacgcagcttgcgcaggtgggaggcgaggcgcacccgcagctcctcggtgctctggccgagcatggcctgca

SEQ ID NO: 3434 - DNA, 17 bp, Homo sapiens
ccacctgcgcaagctgc

SEQ ID NO: 3435 - DNA, 17 bp, Homo sapiens
gcagcttgcgcaggtgg

SEQ ID NO: 3436 - DNA, 121 bp, Homo sapiens
atgctcggccagagcaccgaggagctgcgggtgcgcctcgcctcccacctgcgcaagctgcgtaagcggctcctccgcgatgccgatgacctgcagaagcgcctggcagtgtaccaggccg

SEQ ID NO: 3437 - DNA, 121 bp, Homo sapiens
cggcctggtacactgccaggcgcttctgcaggtcatcggcatcgcggaggagccgcttacgcagcttgcgcaggtgggaggcgaggcgcacccgcagctcctcggtgctctggccgagcat

SEQ ID NO: 3438 - DNA, 17 bp, Homo sapiens
gcaagctgcgtaagcgg

SEQ ID NO: 3439 - DNA, 17 bp, Homo sapiens
ccgcttacgcagcttgc

SEQ ID NO: 3440 - DNA, 121 bp, Homo sapiens
tgctcggccagagcaccgaggagctgcgggtgcgcctcgcctcccacctgcgcaagctgcgtaagcggctcctccgcgatgccgatgacctgcagaagcgcctggcagtgtaccaggccgg

SEQ ID NO: 3441 - DNA, 121 bp, Homo sapiens
ccggcctggtacactgccaggcgcttctgcaggtcatcggcatcgcggaggagccgcttacgcagcttgcgcaggtgggaggcgaggcgcacccgcagctcctcggtgctctggccgagca

SEQ ID NO: 3442 - DNA, 17 bp, Homo sapiens
caagctgcgtaagcggc

SEQ ID NO: 3443 - DNA, 17 bp, Homo sapiens
gccgcttacgcagcttg

SEQ ID NO: 3444 - DNA, 121 bp, Homo sapiens
ctcggccagagcaccgaggagctgcgggtgcgcctcgcctcccacctgcgcaagctgcgtaagcggctcctccgcgatgccgatgacctgcagaagcgcctggcagtgtaccaggccgggg

SEQ ID NO: 3445 - DNA, 121 bp, Homo sapiens
ccccggcctggtacactgccaggcgcttctgcaggtcatcggcatcgcggaggagccgcttacgcagcttgcgcaggtgggaggcgaggcgcacccgcagctcctcggtgctctggccgag

SEQ ID NO: 3446 - DNA, 17 bp, Homo sapiens
agctgcgtaagcggctc

SEQ ID NO: 3447 - DNA, 17 bp, Homo sapiens
gagccgcttacgcagct

SEQ ID NO: 3448 - DNA, 121 bp, Homo sapiens; identical to SEQ ID NO: 3444

SEQ ID NO: 3449 - DNA, 121 bp, Homo sapiens; identical to SEQ ID NO: 3445

SEQ ID NO: 3450 - DNA, 17 bp, Homo sapiens
agctgcgtaagcggctc

SEQ ID NO: 3451 - DNA, 17 bp, Homo sapiens
gagccgcttacgcagct

SEQ ID NO: 3452 - DNA, 121 bp, Homo sapiens
gcctcccacctgcgcaagctgcgtaagcggctcctccgcgatgccgatgacctgcagaagcgcctggcagtgtaccaggccggggcccgcgagggcgccgagcgcggcctcagcgccatcc

SEQ ID NO: 3453 - DNA, 121 bp, Homo sapiens
ggatggcgctgaggccgcgctcggcgccctcgcgggccccggcctggtacactgccaggcgcttctgcaggtcatcggcatcgcggaggagccgcttacgcagcttgcgcaggtgggaggc

SEQ ID NO: 3454 - DNA, 17 bp, Homo sapiens
tgcagaagcgcctggca

SEQ ID NO: 3455 - DNA, 17 bp, Homo sapiens
tgccaggcgcttctgca

SEQ ID NO: 3456 - DNA, 121 bp, Homo sapiens
cgcgagggcgccgagcgcggcctcagcgccatccgcgagcgcctggggcccctggtggaacagggccgcgtgcgggccgccactgtgggctccctggccggccagccgctacaggagcggg

SEQ ID NO: 3457 - DNA, 121 bp, Homo sapiens
cccgctcctgtagcggctggccggccagggagcccacagtggcggcccgcacgcggccctgttccaccaggggccccaggcgctcgcggatggcgctgaggccgcgctcggcgccctcgcg

SEQ ID NO: 3458 - DNA, 17 bp, Homo sapiens
tggtggaacagggccgc

SEQ ID NO: 3459 - DNA, 17 bp, Homo sapiens
gcggccctgttccacca

SEQ ID NO: 3460 - DNA, 121 bp, Homo sapiens
tgcgggccgccactgtgggctccctggccggccagccgctacaggagcgggcccaggcctggggcgagcggctgcgcgcgcggatggaggagatgggcagccggacccgcgaccgcctgga

SEQ ID NO: 3461 - DNA, 121 bp, Homo sapiens
tccaggcggtcgcgggtccggctgcccatctcctccatccgcgcgcgcagccgctcgccccaggcctgggcccgctcctgtagcggctggccggccagggagcccacagtggcggcccgca

SEQ ID NO: 3462 - DNA, 17 bp, Homo sapiens
ccaggcctggggcgagc

SEQ ID NO: 3463 - DNA, 17 bp, Homo sapiens
gctcgccccaggcctgg

SEQ ID NO: 3464 - DNA, 121 bp, Homo sapiens
caggcctggggcgagcggctgcgcgcgcggatggaggagatgggcagccggacccgcgaccgcctggacgaggtgaaggagcaggtggcggaggtgcgcgccaagctggaggagcaggccc

SEQ ID NO: 3465 - DNA, 121 bp, Homo sapiens
gggcctgctcctccagcttggcgcgcacctccgccacctgctccttcacctcgtccaggcggtcgcgggtccggctgcccatctcctccatccgcgcgcgcagccgctcgccccaggcctg

SEQ ID NO: 3466 - DNA, 17 bp, Homo sapiens
cccgcgaccgcctggac

SEQ ID NO: 3467 - DNA, 17 bp, Homo sapiens
gtccaggcggtcgcggg

SEQ ID NO: 3468 - DNA, 121 bp, Homo sapiens
cggacccgcgaccgcctggacgaggtgaaggagcaggtggcggaggtgcgcgccaagctggaggagcaggcccagcagatacgcctgcaggccgaggccttccaggcccgcctcaagagct

SEQ ID NO: 3469 - DNA, 121 bp, Homo sapiens
agctcttgaggcgggcctggaaggcctcggcctgcaggcgtatctgctgggcctgctcctccagcttggcgcgcacctccgccacctgctccttcacctcgtccaggcggtcgcgggtccg

SEQ ID NO: 3470 - DNA, 17 bp, Homo sapiens
ccaagctggaggagcag

SEQ ID NO: 3471 - DNA, 17 bp, Homo sapiens
ctgctcctccagcttgg

SEQ ID NO: 3472 - DNA, 121 bp, Homo sapiens
gcgttgagagaccctttctccttttcctctctctcagtgggcgacagatgcgaaagaaacgagttccagtgccaagacgggaaatgcatctcctacaagtgggtctgcgatggcagcgctg

SEQ ID NO: 3473 - DNA, 121 bp, Homo sapiens
cagcgctgccatcgcagacccacttgtaggagatgcatttcccgtcttggcactggaactcgtttctttcgcatctgtcgcccactgagagagaggaaaaggagaaagggtctctcaacgc

SEQ ID NO: 3474 - DNA, 17 bp, Homo sapiens
aaagaaacgagttccag

SEQ ID NO: 3475 - DNA, 17 bp, Homo sapiens
ctggaactcgtttcttt

SEQ ID NO: 3476 - DNA, 121 bp, Homo sapiens
agagaccctttctccttttcctctctctcagtgggcgacagatgcgaaagaaacgagttccagtgccaagacgggaaatgcatctcctacaagtgggtctgcgatggcagcgctgagtgcc

SEQ ID NO: 3477 - DNA, 121 bp, Homo sapiens
ggcactcagcgctgccatcgcagacccacttgtaggagatgcatttcccgtcttggcactggaactcgtttctttcgcatctgtcgcccactgagagagaggaaaaggagaaagggtctct

SEQ ID NO: 3478 - DNA, 17 bp, Homo sapiens
acgagttccagtgccaa

SEQ ID NO: 3479 - DNA, 17 bp, Homo sapiens
ttggcactggaactcgt

SEQ ID NO: 3480 - DNA, 121 bp, Homo sapiens
cctttctccttttcctctctctcagtgggcgacagatgcgaaagaaacgagttccagtgccaagacgggaaatgcatctcctacaagtgggtctgcgatggcagcgctgagtgccaggatg

SEQ ID NO: 3481 - DNA, 121 bp, Homo sapiens
catcctggcactcagcgctgccatcgcagacccacttgtaggagatgcatttcccgtcttggcactggaactcgtttctttcgcatctgtcgcccactgagagagaggaaaaggagaaagg

SEQ ID NO: 3482 - DNA, 17 bp, Homo sapiens
tccagtgccaagacggg

SEQ ID NO: 3483 - DNA, 17 bp, Homo sapiens
cccgtcttggcactgga

SEQ ID NO: 3484 - DNA, 121 bp, Homo sapiens
gcgacagatgcgaaagaaacgagttccagtgccaagacgggaaatgcatctcctacaagtgggtctgcgatggcagcgctgagtgccaggatggctctgatgagtcccaggagacgtgctg

SEQ ID NO: 3485 - DNA, 121 bp, Homo sapiens
cagcacgtctcctgggactcatcagagccatcctggcactcagcgctgccatcgcagacccacttgtaggagatgcatttcccgtcttggcactggaactcgtttctttcgcatctgtcgc

SEQ ID NO: 3486 - DNA, 17 bp, Homo sapiens
ctacaagtgggtctgcg

SEQ ID NO: 3487 - DNA, 17 bp, Homo sapiens
cgcagacccacttgtag

SEQ ID NO: 3488 - DNA, 121 bp, Homo sapiens
aacgagttccagtgccaagacgggaaatgcatctcctacaagtgggtctgcgatggcagcgctgagtgccaggatggctctgatgagtcccaggagacgtgctgtgagtcccctttgggca

SEQ ID NO: 3489 - DNA, 121 bp, Homo sapiens
tgcccaaaggggactcacagcacgtctcctgggactcatcagagccatcctggcactcagcgctgccatcgcagacccacttgtaggagatgcatttcccgtcttggcactggaactcgtt

SEQ ID NO: 3490 - DNA, 17 bp, Homo sapiens
atggcagcgctgagtgc

SEQ ID NO: 3491 - DNA, 17 bp, Homo sapiens
gcactcagcgctgccat

SEQ ID NO: 3492 - DNA, 121 bp, Homo sapiens
tccagtgccaagacgggaaatgcatctcctacaagtgggtctgcgatggcagcgctgagtgccaggatggctctgatgagtcccaggagacgtgctgtgagtcccctttgggcatgatatg

SEQ ID NO: 3493 - DNA, 121 bp, Homo sapiens
catatcatgcccaaaggggactcacagcacgtctcctgggactcatcagagccatcctggcactcagcgctgccatcgcagacccacttgtaggagatgcatttcccgtcttggcactgga

SEQ ID NO: 3494 - DNA, 17 bp, Homo sapiens
cgctgagtgccaggatg

SEQ ID NO: 3495 - DNA, 17 bp, Homo sapiens
catcctggcactcagcg

SEQ ID NO: 3496 - DNA, 121 bp, Homo sapiens
aatcctgtctcttctgtagtgtctgtcacctgcaaatccggggacttcagctgtgggggccgtgtcaaccgctgcattcctcagttctggaggtgcgatggccaagtggactgcgacaacg

SEQ ID NO: 3497 - DNA, 121 bp, Homo sapiens
cgttgtcgcagtccacttggccatcgcacctccagaactgaggaatgcagcggttgacacggcccccacagctgaagtccccggatttgcaggtgacagacactacagaagagacaggatt

SEQ ID NO: 3498 - DNA, 17 bp, Homo sapiens
gtgggggccgtgtcaac

SEQ ID NO: 3499 - DNA, 17 bp, Homo sapiens
gttgacacggcccccac

SEQ ID NO: 3500 - DNA, 121 bp, Homo sapiens
tctgtcacctgcaaatccggggacttcagctgtgggggccgtgtcaaccgctgcattcctcagttctggaggtgcgatggccaagtggactgcgacaacggctcagacgagcaaggctgtc

SEQ ID NO: 3501 - DNA, 121 bp, Homo sapiens
gacagccttgctcgtctgagccgttgtcgcagtccacttggccatcgcacctccagaactgaggaatgcagcggttgacacggcccccacagctgaagtccccggatttgcaggtgacaga

SEQ ID NO: 3502 - DNA, 17 bp, Homo sapiens
gcattcctcagttctgg

SEQ ID NO: 3503 - DNA, 17 bp, Homo sapiens
ccagaactgaggaatgc

SEQ ID NO: 3504 - DNA, 121 bp, Homo sapiens
acctgcaaatccggggacttcagctgtgggggccgtgtcaaccgctgcattcctcagttctggaggtgcgatggccaagtggactgcgacaacggctcagacgagcaaggctgtcgtaagt

SEQ ID NO: 3505 - DNA, 121 bp, Homo sapiens
acttacgacagccttgctcgtctgagccgttgtcgcagtccacttggccatcgcacctccagaactgaggaatgcagcggttgacacggcccccacagctgaagtccccggatttgcaggt

SEQ ID NO: 3506 - DNA, 17 bp, Homo sapiens
ctcagttctggaggtgc

SEQ ID NO: 3507 - DNA, 17 bp, Homo sapiens
gcacctccagaactgag

SEQ ID NO: 3508 - DNA, 121 bp, Homo sapiens
cctgcaaatccggggacttcagctgtgggggccgtgtcaaccgctgcattcctcagttctggaggtgcgatggccaagtggactgcgacaacggctcagacgagcaaggctgtcgtaagtg

SEQ ID NO: 3509 - DNA, 121 bp, Homo sapiens
cacttacgacagccttgctcgtctgagccgttgtcgcagtccacttggccatcgcacctccagaactgaggaatgcagcggttgacacggcccccacagctgaagtccccggatttgcagg

SEQ ID NO: 3510 - DNA, 17 bp, Homo sapiens
tcagttctggaggtgcg

SEQ ID NO: 3511 - DNA, 17 bp, Homo sapiens
cgcacctccagaactga

SEQ ID NO: 3512 - DNA, 121 bp, Homo sapiens
aaatccggggacttcagctgtgggggccgtgtcaaccgctgcattcctcagttctggaggtgcgatggccaagtggactgcgacaacggctcagacgagcaaggctgtcgtaagtgtggcc

SEQ ID NO: 3513 - DNA, 121 bp, Homo sapiens
ggccacacttacgacagccttgctcgtctgagccgttgtcgcagtccacttggccatcgcacctccagaactgaggaatgcagcggttgacacggcccccacagctgaagtccccggattt

SEQ ID NO: 3514 - DNA, 17 bp, Homo sapiens
tctggaggtgcgatggc

SEQ ID NO: 3515 - DNA, 17 bp, Homo sapiens
gccatcgcacctccaga

SEQ ID NO: 3516 - DNA, 121 bp, Homo sapiens
atccggggacttcagctgtgggggccgtgtcaaccgctgcattcctcagttctggaggtgcgatggccaagtggactgcgacaacggctcagacgagcaaggctgtcgtaagtgtggccct

SEQ ID NO: 3517 - DNA, 121 bp, Homo sapiens
agggccacacttacgacagccttgctcgtctgagccgttgtcgcagtccacttggccatcgcacctccagaactgaggaatgcagcggttgacacggcccccacagctgaagtccccggat

SEQ ID NO: 3518 - DNA, 17 bp, Homo sapiens
tggaggtgcgatggcca

SEQ ID NO: 3519 - DNA, 17 bp, Homo sapiens
tggccatcgcacctcca

SEQ ID NO: 3520 - DNA, 121 bp, Homo sapiens
aatccggggacttcagctgtgggggccgtgtcaaccgctgcattcctcagttctggaggtgcgatggccaagtggactgcgacaacggctcagacgagcaaggctgtcgtaagtgtggccc

SEQ ID NO: 3521 - DNA, 121 bp, Homo sapiens
gggccacacttacgacagccttgctcgtctgagccgttgtcgcagtccacttggccatcgcacctccagaactgaggaatgcagcggttgacacggcccccacagctgaagtccccggatt

SEQ ID NO: 3522 - DNA, 17 bp, Homo sapiens
ctggaggtgcgatggcc

SEQ ID NO: 3523 - DNA, 17 bp, Homo sapiens
ggccatcgcacctccag

SEQ ID NO: 3524 - DNA, 121 bp, Homo sapiens
tccggggacttcagctgtgggggccgtgtcaaccgctgcattcctcagttctggaggtgcgatggccaagtggactgcgacaacggctcagacgagcaaggctgtcgtaagtgtggccctg

SEQ ID NO: 3525 - DNA, 121 bp, Homo sapiens
cagggccacacttacgacagccttgctcgtctgagccgttgtcgcagtccacttggccatcgcacctccagaactgaggaatgcagcggttgacacggcccccacagctgaagtccccgga

SEQ ID NO: 3526 - DNA, 17 bp, Homo sapiens
ggaggtgcgatggccaa

SEQ ID NO: 3527 - DNA, 17 bp, Homo sapiens
ttggccatcgcacctcc

SEQ ID NO: 3528 - DNA, 121 bp, Homo sapiens
ccggggacttcagctgtgggggccgtgtcaaccgctgcattcctcagttctggaggtgcgatggccaagtggactgcgacaacggctcagacgagcaaggctgtcgtaagtgtggccctgc

SEQ ID NO: 3529 - DNA, 121 bp, Homo sapiens
gcagggccacacttacgacagccttgctcgtctgagccgttgtcgcagtccacttggccatcgcacctccagaactgaggaatgcagcggttgacacggcccccacagctgaagtccccgg

SEQ ID NO: 3530 - DNA, 17 bp, Homo sapiens
gaggtgcgatggccaag

SEQ ID NO: 3531 - DNA, 17 bp, Homo sapiens
cttggccatcgcacctc

SEQ ID NO: 3532 - DNA, 121 bp, Homo sapiens; identical to SEQ ID NO: 3524

SEQ ID NO: 3533 - DNA, 121 bp, Homo sapiens; identical to SEQ ID NO: 3525

SEQ ID NO: 3534 - DNA, 17 bp, Homo sapiens
ggaggtgcgatggccaa

SEQ ID NO: 3535 - DNA, 17 bp, Homo sapiens
ttggccatcgcacctcc

SEQ ID NO: 3536 - DNA, 121 bp, Homo sapiens
gacttcagctgtgggggccgtgtcaaccgctgcattcctcagttctggaggtgcgatggccaagtggactgcgacaacggctcagacgagcaaggctgtcgtaagtgtggccctgcctttg

SEQ ID NO: 3537 - DNA, 121 bp, Homo sapiens
caaaggcagggccacacttacgacagccttgctcgtctgagccgttgtcgcagtccacttggccatcgcacctccagaactgaggaatgcagcggttgacacggcccccacagctgaagtc

SEQ ID NO: 3538 - DNA, 17 bp, Homo sapiens
gcgatggccaagtggac

SEQ ID NO: 3539 - DNA, 17 bp, Homo sapiens
gtccacttggccatcgc

SEQ ID NO: 3540 - DNA, 121 bp, Homo sapiens
tgtgggggccgtgtcaaccgctgcattcctcagttctggaggtgcgatggccaagtggactgcgacaacggctcagacgagcaaggctgtcgtaagtgtggccctgcctttgctattgagc

SEQ ID NO: 3541 - DNA, 121 bp, Homo sapiens
gctcaatagcaaaggcagggccacacttacgacagccttgctcgtctgagccgttgtcgcagtccacttggccatcgcacctccagaactgaggaatgcagcggttgacacggcccccaca

SEQ ID NO: 3542 - DNA, 17 bp, Homo sapiens
aagtggactgcgacaac

SEQ ID NO: 3543 - DNA, 17 bp, Homo sapiens
gttgtcgcagtccactt

SEQ ID NO: 3544 - DNA, 121 bp, Homo sapiens
tcaaccgctgcattcctcagttctggaggtgcgatggccaagtggactgcgacaacggctcagacgagcaaggctgtcgtaagtgtggccctgcctttgctattgagcctatctgagtcct

SEQ ID NO: 3545 - DNA, 121 bp, Homo sapiens
aggactcagataggctcaatagcaaaggcagggccacacttacgacagccttgctcgtctgagccgttgtcgcagtccacttggccatcgcacctccagaactgaggaatgcagcggttga

SEQ ID NO: 3546 - DNA, 17 bp, Homo sapiens
caacggctcagacgagc

SEQ ID NO: 3547 - DNA, 17 bp, Homo sapiens
gctcgtctgagccgttg

SEQ ID NO: 3548 - DNA, 121 bp, Homo sapiens
cgctgcattcctcagttctggaggtgcgatggccaagtggactgcgacaacggctcagacgagcaaggctgtcgtaagtgtggccctgcctttgctattgagcctatctgagtcctgggga

SEQ ID NO: 3549 - DNA, 121 bp, Homo sapiens
tccccaggactcagataggctcaatagcaaaggcagggccacacttacgacagccttgctcgtctgagccgttgtcgcagtccacttggccatcgcacctccagaactgaggaatgcagcg

SEQ ID NO: 3550 - DNA, 17 bp, Homo sapiens
gctcagacgagcaaggc

SEQ ID NO: 3551 - DNA, 17 bp, Homo sapiens
gccttgctcgtctgagc

SEQ ID NO: 3552 - DNA, 121 bp, Homo sapiens; identical to SEQ ID NO: 3548

SEQ ID NO: 3553 - DNA, 121 bp, Homo sapiens; identical to SEQ ID NO: 3549

SEQ ID NO: 3554 - DNA, 17 bp, Homo sapiens
gctcagacgagcaaggc

SEQ ID NO: 3555 - DNA, 17 bp, Homo sapiens
gccttgctcgtctgagc

SEQ ID NO: 3556 - DNA, 121 bp, Homo sapiens
tgcattcctcagttctggaggtgcgatggccaagtggactgcgacaacggctcagacgagcaaggctgtcgtaagtgtggccctgcctttgctattgagcctatctgagtcctggggagtg

SEQ ID NO: 3557 - DNA, 121 bp, Homo sapiens
cactccccaggactcagataggctcaatagcaaaggcagggccacacttacgacagccttgctcgtctgagccgttgtcgcagtccacttggccatcgcacctccagaactgaggaatgca

SEQ ID NO: 3558 - DNA, 17 bp, Homo sapiens
cagacgagcaaggctgt

SEQ ID NO: 3559 - DNA, 17 bp, Homo sapiens
acagccttgctcgtctg

SEQ ID NO: 3560 - DNA, 121 bp, Homo sapiens
tgggagacttcacacggtgatggtggtctcggcccatccatccctgcagcccccaagacgtgctcccaggacgagtttcgctgccacgatgggaagtgcatctctcggcagttcgtctgtg

SEQ ID NO: 3561 - DNA, 121 bp, Homo sapiens
cacagacgaactgccgagagatgcacttcccatcgtggcagcgaaactcgtcctgggagcacgtcttgggggctgcagggatggatgggccgagaccaccatcaccgtgtgaagtctccca

SEQ ID NO: 3562 - DNA, 17 bp, Homo sapiens
ccaagacgtgctcccag

SEQ ID NO: 3563 - DNA, 17 bp, Homo sapiens
ctgggagcacgtcttgg

SEQ ID NO: 3564 - DNA, 121 bp, Homo sapiens
cacggtgatggtggtctcggcccatccatccctgcagcccccaagacgtgctcccaggacgagtttcgctgccacgatgggaagtgcatctctcggcagttcgtctgtgactcagaccggg

SEQ ID NO: 3565 - DNA, 121 bp, Homo sapiens
cccggtctgagtcacagacgaactgccgagagatgcacttcccatcgtggcagcgaaactcgtcctgggagcacgtcttgggggctgcagggatggatgggccgagaccaccatcaccgtg

SEQ ID NO: 3566 - DNA, 17 bp, Homo sapiens
cccaggacgagtttcgc

SEQ ID NO: 3567 - DNA, 17 bp, Homo sapiens
gcgaaactcgtcctggg

SEQ ID NO: 3568 - DNA, 121 bp, Homo sapiens
ggtggtctcggcccatccatccctgcagcccccaagacgtgctcccaggacgagtttcgctgccacgatgggaagtgcatctctcggcagttcgtctgtgactcagaccgggactgcttgg

SEQ ID NO: 3569 - DNA, 121 bp, Homo sapiens
ccaagcagtcccggtctgagtcacagacgaactgccgagagatgcacttcccatcgtggcagcgaaactcgtcctgggagcacgtcttgggggctgcagggatggatgggccgagaccacc

SEQ ID NO: 3570 - DNA, 17 bp, Homo sapiens
agtttcgctgccacgat

SEQ ID NO: 3571 - DNA, 17 bp, Homo sapiens
atcgtggcagcgaaact

SEQ ID NO: 3572 - DNA, 121 bp, Homo sapiens
ctcggcccatccatccctgcagcccccaagacgtgctcccaggacgagtttcgctgccacgatgggaagtgcatctctcggcagttcgtctgtgactcagaccgggactgcttggacggct

SEQ ID NO: 3573 - DNA, 121 bp, Homo sapiens
agccgtccaagcagtcccggtctgagtcacagacgaactgccgagagatgcacttcccatcgtggcagcgaaactcgtcctgggagcacgtcttgggggctgcagggatggatgggccgag

SEQ ID NO: 3574 - DNA, 17 bp, Homo sapiens
gctgccacgatgggaag

SEQ ID NO: 3575 - DNA, 17 bp, Homo sapiens
cttcccatcgtggcagc

SEQ ID NO: 3576 - DNA, 121 bp, Homo sapiens
gggtcgggacactgcctggcagaggctgcgagcatggggccctggggctggaaattgcgctggaccgtcgccttgctcctcgccgcggcggggactgcaggtaaggcttgctccaggcgcc

SEQ ID NO: 3577 - DNA, 121 bp, Homo sapiens
ggcgcctggagcaagccttacctgcagtccccgccgcggcgaggagcaaggcgacggtccagcgcaatttccagccccagggccccatgctcgcagcctctgccaggcagtgtcccgaccc

SEQ ID NO: 3578 - DNA, 17 bp, Homo sapiens
aattgcgctggaccgtc

SEQ ID NO: 3579 - DNA, 17 bp, Homo sapiens
gacggtccagcgcaatt

SEQ ID NO: 3580 - DNA, 121 bp, Homo sapiens
cagcaggtcgtgatccgggtcgggacactgcctggcagaggctgcgagcatggggccctggggctggaaattgcgctggaccgtcgccttgctcctcgccgcggcggggactgcaggtaag

SEQ ID NO: 3581 - DNA, 121 bp, Homo sapiens
cttacctgcagtccccgccgcggcgaggagcaaggcgacggtccagcgcaatttccagccccagggccccatgctcgcagcctctgccaggcagtgtcccgacccggatcacgacctgctg

SEQ ID NO: 3582 - DNA, 17 bp, Homo sapiens
gggccctggggctggaa

SEQ ID NO: 3583 - DNA, 17 bp, Homo sapiens
ttccagccccagggccc

SEQ ID NO: 3584 - DNA, 121 bp, Homo sapiens
cagctaggacacagcaggtcgtgatccgggtcgggacactgcctggcagaggctgcgagcatggggccctggggctggaaattgcgctggaccgtcgccttgctcctcgccgcggcgggga

SEQ ID NO: 3585 - DNA, 121 bp, Homo sapiens
tccccgccgcggcgaggagcaaggcgacggtccagcgcaatttccagccccagggccccatgctcgcagcctctgccaggcagtgtcccgacccggatcacgacctgctgtgtcctagctg

SEQ ID NO: 3586 - DNA, 17 bp, Homo sapiens
ctgcgagcatggggccc

SEQ ID NO: 3587 - DNA, 17 bp, Homo sapiens
gggccccatgctcgcag

SEQ ID NO: 3588 - DNA, 121 bp, Homo sapiens; identical to SEQ ID NO: 3584

SEQ ID NO: 3589 - DNA, 121 bp, Homo sapiens; identical to SEQ ID NO: 3585

SEQ ID NO: 3590 - DNA, 17 bp, Homo sapiens
ctgcgagcatggggccc

SEQ ID NO: 3591 - DNA, 17 bp, Homo sapiens
gggccccatgctcgcag

SEQ ID NO: 3592 - DNA, 121 bp, Homo sapiens
atccctgcagcccccaagacgtgctcccaggacgagtttcgctgccacgatgggaagtgcatctctcggcagttcgtctgtgactcagaccgggactgcttggacggctcagacgaggcct

SEQ ID NO: 3593 - DNA, 121 bp, Homo sapiens
aggcctcgtctgagccgtccaagcagtcccggtctgagtcacagacgaactgccgagagatgcacttcccatcgtggcagcgaaactcgtcctgggagcacgtcttgggggctgcagggat

SEQ ID NO: 3594 - DNA, 17 bp, Homo sapiens
ggaagtgcatctctcgg

SEQ ID NO: 3595 - DNA, 17 bp, Homo sapiens
ccgagagatgcacttcc

SEQ ID NO: 3596 - DNA, 121 bp, Homo sapiens
gcccccaagacgtgctcccaggacgagtttcgctgccacgatgggaagtgcatctctcggcagttcgtctgtgactcagaccgggactgcttggacggctcagacgaggcctcctgcccgg

SEQ ID NO: 3597 - DNA, 121 bp, Homo sapiens
ccgggcaggaggcctcgtctgagccgtccaagcagtcccggtctgagtcacagacgaactgccgagagatgcacttcccatcgtggcagcgaaactcgtcctgggagcacgtcttgggggc

SEQ ID NO: 3598 - DNA, 17 bp, Homo sapiens
tctctcggcagttcgtc

SEQ ID NO: 3599 - DNA, 17 bp, Homo sapiens
gacgaactgccgagaga

SEQ ID NO: 3600 - DNA, 121 bp, Homo sapiens
tttcgctgccacgatgggaagtgcatctctcggcagttcgtctgtgactcagaccgggactgcttggacggctcagacgaggcctcctgcccggtgctcacctgtggtcccgccagcttcc

SEQ ID NO: 3601 - DNA, 121 bp, Homo sapiens
ggaagctggcgggaccacaggtgagcaccgggcaggaggcctcgtctgagccgtccaagcagtcccggtctgagtcacagacgaactgccgagagatgcacttcccatcgtggcagcgaaa

SEQ ID NO: 3602 - DNA, 17 bp, Homo sapiens
accgggactgcttggac

SEQ ID NO: 3603 - DNA, 17 bp, Homo sapiens
gtccaagcagtcccggt

SEQ ID NO: 3604 - DNA, 121 bp, Homo sapiens
aagtgcatctctcggcagttcgtctgtgactcagaccgggactgcttggacggctcagacgaggcctcctgcccggtgctcacctgtggtcccgccagcttccagtgcaacagctccacct

SEQ ID NO: 3605 - DNA, 121 bp, Homo sapiens
aggtggagctgttgcactggaagctggcgggaccacaggtgagcaccgggcaggaggcctcgtctgagccgtccaagcagtcccggtctgagtcacagacgaactgccgagagatgcactt

SEQ ID NO: 3606 - DNA, 17 bp, Homo sapiens
gctcagacgaggcctcc

SEQ ID NO: 3607 - DNA, 17 bp, Homo sapiens
ggaggcctcgtctgagc

SEQ ID NO: 3608 - DNA, 121 bp, Homo sapiens; identical to SEQ ID NO: 3604

SEQ ID NO: 3609 - DNA, 121 bp, Homo sapiens; identical to SEQ ID NO: 3605

SEQ ID NO: 3610 - DNA, 17 bp, Homo sapiens
gctcagacgaggcctcc

SEQ ID NO: 3611 - DNA, 17 bp, Homo sapiens
ggaggcctcgtctgagc

SEQ ID NO: 3612 - DNA, 121 bp, Homo sapiens
tcggcagttcgtctgtgactcagaccgggactgcttggacggctcagacgaggcctcctgcccggtgctcacctgtggtcccgccagcttccagtgcaacagctccacctgcatcccccag

SEQ ID NO: 3613 - DNA, 121 bp, Homo sapiens
ctgggggatgcaggtggagctgttgcactggaagctggcgggaccacaggtgagcaccgggcaggaggcctcgtctgagccgtccaagcagtcccggtctgagtcacagacgaactgccga

SEQ ID NO: 3614 - DNA, 17 bp, Homo sapiens
gcctcctgcccggtgct

SEQ ID NO: 3615 - DNA, 17 bp, Homo sapiens
agcaccgggcaggaggc

SEQ ID NO: 3616 - DNA, 121 bp, Homo sapiens
tgactcagaccgggactgcttggacggctcagacgaggcctcctgcccggtgctcacctgtggtcccgccagcttccagtgcaacagctccacctgcatcccccagctgtgggcctgcgac

SEQ ID NO: 3617 - DNA, 121 bp, Homo sapiens
gtcgcaggcccacagctgggggatgcaggtggagctgttgcactggaagctggcgggaccacaggtgagcaccgggcaggaggcctcgtctgagccgtccaagcagtcccggtctgagtca

SEQ ID NO: 3618 - DNA, 17 bp, Homo sapiens
ctcacctgtggtcccgc

SEQ ID NO: 3619 - DNA, 17 bp, Homo sapiens
gcgggaccacaggtgag

SEQ ID NO: 3620 - DNA, 121 bp, Homo sapiens
tgcttggacggctcagacgaggcctcctgcccggtgctcacctgtggtcccgccagcttccagtgcaacagctccacctgcatcccccagctgtgggcctgcgacaacgaccccgactgcg

SEQ ID NO: 3621 - DNA, 121 bp, Homo sapiens
cgcagtcggggtcgttgtcgcaggcccacagctgggggatgcaggtggagctgttgcactggaagctggcgggaccacaggtgagcaccgggcaggaggcctcgtctgagccgtccaagca

SEQ ID NO: 3622 - DNA, 17 bp, Homo sapiens
ccagcttccagtgcaac

SEQ ID NO: 3623 - DNA, 17 bp, Homo sapiens
gttgcactggaagctgg

SEQ ID NO: 3624 - DNA, 121 bp, Homo sapiens
ttggacggctcagacgaggcctcctgcccggtgctcacctgtggtcccgccagcttccagtgcaacagctccacctgcatcccccagctgtgggcctgcgacaacgaccccgactgcgaag

SEQ ID NO: 3625 - DNA, 121 bp, Homo sapiens
cttcgcagtcggggtcgttgtcgcaggcccacagctgggggatgcaggtggagctgttgcactggaagctggcgggaccacaggtgagcaccgggcaggaggcctcgtctgagccgtccaa

SEQ ID NO: 3626 - DNA, 17 bp, Homo sapiens
gcttccagtgcaacagc

SEQ ID NO: 3627 - DNA, 17 bp, Homo sapiens
gctgttgcactggaagc

SEQ ID NO: 3628 - DNA, 121 bp, Homo sapiens
gaggcctcctgcccggtgctcacctgtggtcccgccagcttccagtgcaacagctccacctgcatcccccagctgtgggcctgcgacaacgaccccgactgcgaagatggctcggatgagt

SEQ ID NO: 3629 - DNA, 121 bp, Homo sapiens
actcatccgagccatcttcgcagtcggggtcgttgtcgcaggcccacagctgggggatgcaggtggagctgttgcactggaagctggcgggaccacaggtgagcaccgggcaggaggcctc

SEQ ID NO: 3630 - DNA, 17 bp, Homo sapiens
gctccacctgcatcccc

SEQ ID NO: 3631 - DNA, 17 bp, Homo sapiens
ggggatgcaggtggagc

SEQ ID NO: 3632 - DNA, 121 bp, Homo sapiens
aggcctcctgcccggtgctcacctgtggtcccgccagcttccagtgcaacagctccacctgcatcccccagctgtgggcctgcgacaacgaccccgactgcgaagatggctcggatgagtg

SEQ ID NO: 3633 - DNA, 121 bp, Homo sapiens
cactcatccgagccatcttcgcagtcggggtcgttgtcgcaggcccacagctgggggatgcaggtggagctgttgcactggaagctggcgggaccacaggtgagcaccgggcaggaggcct

SEQ ID NO: 3634 - DNA, 17 bp, Homo sapiens
ctccacctgcatccccc

SEQ ID NO: 3635 - DNA, 17 bp, Homo sapiens
gggggatgcaggtggag

SEQ ID NO: 3636 - DNA, 121 bp, Homo sapiens
ctgtggtcccgccagcttccagtgcaacagctccacctgcatcccccagctgtgggcctgcgacaacgaccccgactgcgaagatggctcggatgagtggccgcagcgctgtaggggtctt

SEQ ID NO: 3637 - DNA, 121 bp, Homo sapiens
aagacccctacagcgctgcggccactcatccgagccatcttcgcagtcggggtcgttgtcgcaggcccacagctgggggatgcaggtggagctgttgcactggaagctggcgggaccacag

SEQ ID NO: 3638 - DNA, 17 bp, Homo sapiens
tgggcctgcgacaacga

SEQ ID NO: 3639 - DNA, 17 bp, Homo sapiens
tcgttgtcgcaggccca

SEQ ID NO: 3640 - DNA, 121 bp, Homo sapiens
tgtggtcccgccagcttccagtgcaacagctccacctgcatcccccagctgtgggcctgcgacaacgaccccgactgcgaagatggctcggatgagtggccgcagcgctgtaggggtcttt

SEQ ID NO: 3641 - DNA, 121 bp, Homo sapiens
aaagacccctacagcgctgcggccactcatccgagccatcttcgcagtcggggtcgttgtcgcaggcccacagctgggggatgcaggtggagctgttgcactggaagctggcgggaccaca

SEQ ID NO: 3642 - DNA, 17 bp, Homo sapiens
gggcctgcgacaacgac

SEQ ID NO: 3643 - DNA, 17 bp, Homo sapiens
gtcgttgtcgcaggccc

SEQ ID NO: 3644 - DNA, 121 bp, Homo sapiens; identical to SEQ ID NO: 3640

SEQ ID NO: 3645 - DNA, 121 bp, Homo sapiens; identical to SEQ ID NO: 3641

SEQ ID NO: 3646 - DNA, 17 bp, Homo sapiens
gggcctgcgacaacgac

SEQ ID NO: 3647 - DNA, 17 bp, Homo sapiens
gtcgttgtcgcaggccc

SEQ ID NO: 3648 - DNA, 121 bp, Homo sapiens; identical to SEQ ID NO: 3640

SEQ ID NO: 3649 - DNA, 121 bp, Homo sapiens; identical to SEQ ID NO: 3641

SEQ ID NO: 3650 - DNA, 17 bp, Homo sapiens
gggcctgcgacaacgac

SEQ ID NO: 3651 - DNA, 17 bp, Homo sapiens
gtcgttgtcgcaggccc

SEQ ID NO: 3652 - DNA, 121 bp, Homo sapiens
ttccagtgcaacagctccacctgcatcccccagctgtgggcctgcgacaacgaccccgactgcgaagatggctcggatgagtggccgcagcgctgtaggggtctttacgtgttccaagggg

SEQ ID NO: 3653 - DNA, 121 bp, Homo sapiens
ccccttggaacacgtaaagacccctacagcgctgcggccactcatccgagccatcttcgcagtcggggtcgttgtcgcaggcccacagctgggggatgcaggtggagctgttgcactggaa

SEQ ID NO: 3654 - DNA, 17 bp, Homo sapiens
accccgactgcgaagat

SEQ ID NO: 3655 - DNA, 17 bp, Homo sapiens
atcttcgcagtcggggt

SEQ ID NO: 3656 - DNA, 121 bp, Homo sapiens; identical to SEQ ID NO: 3652

SEQ ID NO: 3657 - DNA, 121 bp, Homo sapiens; identical to SEQ ID NO: 3653

SEQ ID NO: 3658 - DNA, 17 bp, Homo sapiens
accccgactgcgaagat

SEQ ID NO: 3659 - DNA, 17 bp, Homo sapiens
atcttcgcagtcggggt

SEQ ID NO: 3660 - DNA, 121 bp, Homo sapiens
ccagtgcaacagctccacctgcatcccccagctgtgggcctgcgacaacgaccccgactgcgaagatggctcggatgagtggccgcagcgctgtaggggtctttacgtgttccaaggggac

SEQ ID NO: 3661 - DNA, 121 bp, Homo sapiens
gtccccttggaacacgtaaagacccctacagcgctgcggccactcatccgagccatcttcgcagtcggggtcgttgtcgcaggcccacagctgggggatgcaggtggagctgttgcactgg

SEQ ID NO: 3662 - DNA, 17 bp, Homo sapiens
cccgactgcgaagatgg

SEQ ID NO: 3663 - DNA, 17 bp, Homo sapiens
ccatcttcgcagtcggg

SEQ ID NO: 3664 - DNA, 121 bp, Homo sapiens
tgcaacagctccacctgcatcccccagctgtgggcctgcgacaacgaccccgactgcgaagatggctcggatgagtggccgcagcgctgtaggggtctttacgtgttccaaggggacagta

SEQ ID NO: 3665 - DNA, 121 bp, Homo sapiens
tactgtccccttggaacacgtaaagacccctacagcgctgcggccactcatccgagccatcttcgcagtcggggtcgttgtcgcaggcccacagctgggggatgcaggtggagctgttgca

SEQ ID NO: 3666 - DNA, 17 bp, Homo sapiens
actgcgaagatggctcg

SEQ ID NO: 3667 - DNA, 17 bp, Homo sapiens
cgagccatcttcgcagt

SEQ ID NO: 3668 - DNA, 121 bp, Homo sapiens
gctccacctgcatcccccagctgtgggcctgcgacaacgaccccgactgcgaagatggctcggatgagtggccgcagcgctgtaggggtctttacgtgttccaaggggacagtagcccctg

SEQ ID NO: 3669 - DNA, 121 bp, Homo sapiens
caggggctactgtccccttggaacacgtaaagacccctacagcgctgcggccactcatccgagccatcttcgcagtcggggtcgttgtcgcaggcccacagctgggggatgcaggtggagc

SEQ ID NO: 3670 - DNA, 17 bp, Homo sapiens
agatggctcggatgagt

SEQ ID NO: 3671 - DNA, 17 bp, Homo sapiens
actcatccgagccatct

SEQ ID NO: 3672 - DNA, 121 bp, Homo sapiens
tgtgggcctgcgacaacgaccccgactgcgaagatggctcggatgagtggccgcagcgctgtaggggtctttacgtgttccaaggggacagtagcccctgctcggccttcgagttccactg

SEQ ID NO: 3673 - DNA, 121 bp, Homo sapiens
cagtggaactcgaaggccgagcaggggctactgtccccttggaacacgtaaagacccctacagcgctgcggccactcatccgagccatcttcgcagtcggggtcgttgtcgcaggcccaca

SEQ ID NO: 3674 - DNA, 17 bp, Homo sapiens
gcagcgctgtaggggtc

SEQ ID NO: 3675 - DNA, 17 bp, Homo sapiens
gacccctacagcgctgc

SEQ ID NO: 3676 - DNA, 121 bp, Homo sapiens
caacgaccccgactgcgaagatggctcggatgagtggccgcagcgctgtaggggtctttacgtgttccaaggggacagtagcccctgctcggccttcgagttccactgcctaagtggcgag

SEQ ID NO: 3677 - DNA, 121 bp, Homo sapiens
ctcgccacttaggcagtggaactcgaaggccgagcaggggctactgtccccttggaacacgtaaagacccctacagcgctgcggccactcatccgagccatcttcgcagtcggggtcgttg

SEQ ID NO: 3678 - DNA, 17 bp, Homo sapiens
ggtctttacgtgttcca

SEQ ID NO: 3679 - DNA, 17 bp, Homo sapiens
tggaacacgtaaagacc

SEQ ID NO: 3680 - DNA, 121 bp, Homo sapiens
cccgactgcgaagatggctcggatgagtggccgcagcgctgtaggggtctttacgtgttccaaggggacagtagcccctgctcggccttcgagttccactgcctaagtggcgagtgcatcc

SEQ ID NO: 3681 - DNA, 121 bp, Homo sapiens
ggatgcactcgccacttaggcagtggaactcgaaggccgagcaggggctactgtccccttggaacacgtaaagacccctacagcgctgcggccactcatccgagccatcttcgcagtcggg

SEQ ID NO: 3682 - DNA, 17 bp, Homo sapiens
acgtgttccaaggggac

SEQ ID NO: 3683 - DNA, 17 bp, Homo sapiens
gtccccttggaacacgt

SEQ ID NO: 3684 - DNA, 121 bp, Homo sapiens
cggatgagtggccgcagcgctgtaggggtctttacgtgttccaaggggacagtagcccctgctcggccttcgagttccactgcctaagtggcgagtgcatccactccagctggcgctgtga

SEQ ID NO: 3685 - DNA, 121 bp, Homo sapiens
tcacagcgccagctggagtggatgcactcgccacttaggcagtggaactcgaaggccgagcaggggctactgtccccttggaacacgtaaagacccctacagcgctgcggccactcatccg

SEQ ID NO: 3686 - DNA, 17 bp, Homo sapiens
tagcccctgctcggcct

SEQ ID NO: 3687 - DNA, 17 bp, Homo sapiens
aggccgagcaggggcta

SEQ ID NO: 3688 - DNA, 121 bp, Homo sapiens; identical to SEQ ID NO: 3684

SEQ ID NO: 3689 - DNA, 121 bp, Homo sapiens; identical to SEQ ID NO: 3685

SEQ ID NO: 3690 - DNA, 17 bp, Homo sapiens
tagcccctgctcggcct

SEQ ID NO: 3691 - DNA, 17 bp, Homo sapiens
aggccgagcaggggcta

SEQ ID NO: 3692 - DNA, 121 bp, Homo sapiens
atgagtggccgcagcgctgtaggggtctttacgtgttccaaggggacagtagcccctgctcggccttcgagttccactgcctaagtggcgagtgcatccactccagctggcgctgtgatgg

SEQ ID NO: 3693 - DNA, 121 bp, Homo sapiens
ccatcacagcgccagctggagtggatgcactcgccacttaggcagtggaactcgaaggccgagcaggggctactgtccccttggaacacgtaaagacccctacagcgctgcggccactcat

SEQ ID NO: 3694 - DNA, 17 bp, Homo sapiens
cccctgctcggccttcg

SEQ ID NO: 3695 - DNA, 17 bp, Homo sapiens
cgaaggccgagcagggg

SEQ ID NO: 3696 - DNA, 121 bp, Homo sapiens
tacgtgttccaaggggacagtagcccctgctcggccttcgagttccactgcctaagtggcgagtgcatccactccagctggcgctgtgatggtggccccgactgcaaggacaaatctgacg

SEQ ID NO: 3697 - DNA, 121 bp, Homo sapiens
cgtcagatttgtccttgcagtcggggccaccatcacagcgccagctggagtggatgcactcgccacttaggcagtggaactcgaaggccgagcaggggctactgtccccttggaacacgta

SEQ ID NO: 3698 - DNA, 17 bp, Homo sapiens
taagtggcgagtgcatc

SEQ ID NO: 3699 - DNA, 17 bp, Homo sapiens
gatgcactcgccactta

SEQ ID NO: 3700 - DNA, 121 bp, Homo sapiens
caaggggacagtagcccctgctcggccttcgagttccactgcctaagtggcgagtgcatccactccagctggcgctgtgatggtggccccgactgcaaggacaaatctgacgaggaaaact

SEQ ID NO: 3701 - DNA, 121 bp, Homo sapiens
agttttcctcgtcagatttgtccttgcagtcggggccaccatcacagcgccagctggagtggatgcactcgccacttaggcagtggaactcgaaggccgagcaggggctactgtccccttg

SEQ ID NO: 3702 - DNA, 17 bp, Homo sapiens
agtgcatccactccagc

SEQ ID NO: 3703 - DNA, 17 bp, Homo sapiens
gctggagtggatgcact

SEQ ID NO: 3704 - DNA, 121 bp, Homo sapiens
ccttcgagttccactgcctaagtggcgagtgcatccactccagctggcgctgtgatggtggccccgactgcaaggacaaatctgacgaggaaaactgcggtatgggcggggccagggtggg

SEQ ID NO: 3705 - DNA, 121 bp, Homo sapiens
cccaccctggccccgcccataccgcagttttcctcgtcagatttgtccttgcagtcggggccaccatcacagcgccagctggagtggatgcactcgccacttaggcagtggaactcgaagg

SEQ ID NO: 3706 - DNA, 17 bp, Homo sapiens
tgatggtggccccgact

SEQ ID NO: 3707 - DNA, 17 bp, Homo sapiens
agtcggggccaccatca

SEQ ID NO: 3708 - DNA, 121 bp, Homo sapiens
gagttccactgcctaagtggcgagtgcatccactccagctggcgctgtgatggtggccccgactgcaaggacaaatctgacgaggaaaactgcggtatgggcggggccagggtgggggcgg

SEQ ID NO: 3709 - DNA, 121 bp, Homo sapiens
ccgcccccaccctggccccgcccataccgcagttttcctcgtcagatttgtccttgcagtcggggccaccatcacagcgccagctggagtggatgcactcgccacttaggcagtggaactc

SEQ ID NO: 3710 - DNA, 17 bp, Homo sapiens
gtggccccgactgcaag

SEQ ID NO: 3711 - DNA, 17 bp, Homo sapiens
cttgcagtcggggccac

SEQ ID NO: 3712 - DNA, 121 bp, Homo sapiens
agttccactgcctaagtggcgagtgcatccactccagctggcgctgtgatggtggccccgactgcaaggacaaatctgacgaggaaaactgcggtatgggcggggccagggtgggggcggg

SEQ ID NO: 3713 - DNA, 121 bp, Homo sapiens
cccgcccccaccctggccccgcccataccgcagttttcctcgtcagatttgtccttgcagtcggggccaccatcacagcgccagctggagtggatgcactcgccacttaggcagtggaact

SEQ ID NO: 3714 - DNA, 17 bp, Homo sapiens
tggccccgactgcaagg

SEQ ID NO: 3715 - DNA, 17 bp, Homo sapiens
ccttgcagtcggggcca

SEQ ID NO: 3716 - DNA, 121 bp, Homo sapiens; identical to SEQ ID NO: 3708

SEQ ID NO: 3717 - DNA, 121 bp, Homo sapiens; identical to SEQ ID NO: 3709

SEQ ID NO: 3718 - DNA, 17 bp, Homo sapiens
gtggccccgactgcaag

SEQ ID NO: 3719 - DNA, 17 bp, Homo sapiens
cttgcagtcggggccac

SEQ ID NO: 3720 - DNA, 121 bp, Homo sapiens
ccactgcctaagtggcgagtgcatccactccagctggcgctgtgatggtggccccgactgcaaggacaaatctgacgaggaaaactgcggtatgggcggggccagggtgggggcggggcgt

SEQ ID NO: 3721 - DNA, 121 bp, Homo sapiens
acgccccgcccccaccctggccccgcccataccgcagttttcctcgtcagatttgtccttgcagtcggggccaccatcacagcgccagctggagtggatgcactcgccacttaggcagtgg

SEQ ID NO: 3722 - DNA, 17 bp, Homo sapiens
cccgactgcaaggacaa

SEQ ID NO: 3723 - DNA, 17 bp, Homo sapiens
ttgtccttgcagtcggg

SEQ ID NO: 3724 - DNA, 121 bp, Homo sapiens
tccactgcctaagtggcgagtgcatccactccagctggcgctgtgatggtggccccgactgcaaggacaaatctgacgaggaaaactgcggtatgggcggggccagggtgggggcggggcg

SEQ ID NO: 3725 - DNA, 121 bp, Homo sapiens
cgccccgcccccaccctggccccgcccataccgcagttttcctcgtcagatttgtccttgcagtcggggccaccatcacagcgccagctggagtggatgcactcgccacttaggcagtgga

SEQ ID NO: 3726 - DNA, 17 bp, Homo sapiens
ccccgactgcaaggaca

SEQ ID NO: 3727 - DNA, 17 bp, Homo sapiens
tgtccttgcagtcgggg

SEQ ID NO: 3728 - DNA, 121 bp, Homo sapiens
tgcctaagtggcgagtgcatccactccagctggcgctgtgatggtggccccgactgcaaggacaaatctgacgaggaaaactgcggtatgggcggggccagggtgggggcggggcgtccta

SEQ ID NO: 3729 - DNA, 121 bp, Homo sapiens
taggacgccccgcccccaccctggccccgcccataccgcagttttcctcgtcagatttgtccttgcagtcggggccaccatcacagcgccagctggagtggatgcactcgccacttaggca

SEQ ID NO: 3730 - DNA, 17 bp, Homo sapiens
actgcaaggacaaatct

SEQ ID NO: 3731 - DNA, 17 bp, Homo sapiens
agatttgtccttgcagt

SEQ ID NO: 3732 - DNA, 121 bp, Homo sapiens
gcctaagtggcgagtgcatccactccagctggcgctgtgatggtggccccgactgcaaggacaaatctgacgaggaaaactgcggtatgggcggggccagggtgggggcggggcgtcctat

SEQ ID NO: 3733 - DNA, 121 bp, Homo sapiens
ataggacgccccgcccccaccctggccccgcccataccgcagttttcctcgtcagatttgtccttgcagtcggggccaccatcacagcgccagctggagtggatgcactcgccacttaggc

SEQ ID NO: 3734 - DNA, 17 bp, Homo sapiens
ctgcaaggacaaatctg

SEQ ID NO: 3735 - DNA, 17 bp, Homo sapiens
cagatttgtccttgcag

SEQ ID NO: 3736 - DNA, 121 bp, Homo sapiens; identical to SEQ ID NO: 3732

SEQ ID NO: 3737 - DNA, 121 bp, Homo sapiens; identical to SEQ ID NO: 3733

SEQ ID NO: 3738 - DNA, 17 bp, Homo sapiens
ctgcaaggacaaatctg

SEQ ID NO: 3739 - DNA, 17 bp, Homo sapiens
cagatttgtccttgcag

SEQ ID NO: 3740 - DNA, 121 bp, Homo sapiens
agtggcgagtgcatccactccagctggcgctgtgatggtggccccgactgcaaggacaaatctgacgaggaaaactgcggtatgggcggggccagggtgggggcggggcgtcctatcacct

SEQ ID NO: 3741 - DNA, 121 bp, Homo sapiens
aggtgataggacgccccgcccccaccctggccccgcccataccgcagttttcctcgtcagatttgtccttgcagtcggggccaccatcacagcgccagctggagtggatgcactcgccact

SEQ ID NO: 3742 - DNA, 17 bp, Homo sapiens
aggacaaatctgacgag

SEQ ID NO: 3743 - DNA, 17 bp, Homo sapiens
ctcgtcagatttgtcct

SEQ ID NO: 3744 - DNA, 121 bp, Homo sapiens
cgagtgcatccactccagctggcgctgtgatggtggccccgactgcaaggacaaatctgacgaggaaaactgcggtatgggcggggccagggtgggggcggggcgtcctatcacctgtccc

SEQ ID NO: 3745 - DNA, 121 bp, Homo sapiens
gggacaggtgataggacgccccgcccccaccctggccccgcccataccgcagttttcctcgtcagatttgtccttgcagtcggggccaccatcacagcgccagctggagtggatgcactcg

SEQ ID NO: 3746 - DNA, 17 bp, Homo sapiens
aaatctgacgaggaaaa

SEQ ID NO: 3747 - DNA, 17 bp, Homo sapiens
ttttcctcgtcagattt

SEQ ID NO: 3748 - DNA, 121 bp, Homo sapiens
gagtgcatccactccagctggcgctgtgatggtggccccgactgcaaggacaaatctgacgaggaaaactgcggtatgggcggggccagggtgggggcggggcgtcctatcacctgtccct

SEQ ID NO: 3749 - DNA, 121 bp, Homo sapiens
agggacaggtgataggacgccccgcccccaccctggccccgcccataccgcagttttcctcgtcagatttgtccttgcagtcggggccaccatcacagcgccagctggagtggatgcactc

SEQ ID NO: 3750 - DNA, 17 bp, Homo sapiens
aatctgacgaggaaaac

SEQ ID NO: 3751 - DNA, 17 bp, Homo sapiens
gttttcctcgtcagatt

SEQ ID NO: 3752 - DNA, 121 bp, Homo sapiens; identical to SEQ ID NO: 3748

SEQ ID NO: 3753 - DNA, 121 bp, Homo sapiens; identical to SEQ ID NO: 3749

SEQ ID NO: 3754 - DNA, 17 bp, Homo sapiens
aatctgacgaggaaaac

SEQ ID NO: 3755 - DNA, 17 bp, Homo sapiens
gttttcctcgtcagatt

SEQ ID NO: 3756 - DNA, 121 bp, Homo sapiens; identical to SEQ ID NO: 3748

SEQ ID NO: 3757 - DNA, 121 bp, Homo sapiens; identical to SEQ ID NO: 3749

SEQ ID NO: 3758 - DNA, 17 bp, Homo sapiens
aatctgacgaggaaaac

SEQ ID NO: 3759 - DNA, 17 bp, Homo sapiens
gttttcctcgtcagatt

SEQ ID NO: 3760 - DNA, 121 bp, Homo sapiens
tcttgagaaaatcaacacactctgtcctgttttccagctgtggccacctgtcgccctgacgaattccagtgctctgatggaaactgcatccatggcagccggcagtgtgaccgggaatatg

SEQ ID NO: 3761 - DNA, 121 bp, Homo sapiens
catattcccggtcacactgccggctgccatggatgcagtttccatcagagcactggaattcgtcagggcgacaggtggccacagctggaaaacaggacagagtgtgttgattttctcaaga

SEQ ID NO: 3762 - DNA, 17 bp, Homo sapiens
gccctgacgaattccag

SEQ ID NO: 3763 - DNA, 17 bp, Homo sapiens
ctggaattcgtcagggc

SEQ ID NO: 3764 - DNA, 121 bp, Homo sapiens
gaaaatcaacacactctgtcctgttttccagctgtggccacctgtcgccctgacgaattccagtgctctgatggaaactgcatccatggcagccggcagtgtgaccgggaatatgactgca

SEQ ID NO: 3765 - DNA, 121 bp, Homo sapiens
tgcagtcatattcccggtcacactgccggctgccatggatgcagtttccatcagagcactggaattcgtcagggcgacaggtggccacagctggaaaacaggacagagtgtgttgattttc

SEQ ID NO: 3766 - DNA, 17 bp, Homo sapiens
acgaattccagtgctct

SEQ ID NO: 3767 - DNA, 17 bp, Homo sapiens
agagcactggaattcgt

SEQ ID NO: 3768 - DNA, 121 bp, Homo sapiens
cctgttttccagctgtggccacctgtcgccctgacgaattccagtgctctgatggaaactgcatccatggcagccggcagtgtgaccgggaatatgactgcaaggacatgagcgatgaagt

SEQ ID NO: 3769 - DNA, 121 bp, Homo sapiens
acttcatcgctcatgtccttgcagtcatattcccggtcacactgccggctgccatggatgcagtttccatcagagcactggaattcgtcagggcgacaggtggccacagctggaaaacagg

SEQ ID NO: 3770 - DNA, 17 bp, Homo sapiens
tggaaactgcatccatg

SEQ ID NO: 3771 - DNA, 17 bp, Homo sapiens
catggatgcagtttcca

SEQ ID NO: 3772 - DNA, 121 bp, Homo sapiens
tcgccctgacgaattccagtgctctgatggaaactgcatccatggcagccggcagtgtgaccgggaatatgactgcaaggacatgagcgatgaagttggctgcgttaatggtgagcgctgg

SEQ ID NO: 3773 - DNA, 121 bp, Homo sapiens
ccagcgctcaccattaacgcagccaacttcatcgctcatgtccttgcagtcatattcccggtcacactgccggctgccatggatgcagtttccatcagagcactggaattcgtcagggcga

SEQ ID NO: 3774 - DNA, 17 bp, Homo sapiens
cagtgtgaccgggaata

SEQ ID NO: 3775 - DNA, 17 bp, Homo sapiens
tattcccggtcacactg

SEQ ID NO: 3776 - DNA, 121 bp, Homo sapiens
gtcgccctgacgaattccagtgctctgatggaaactgcatccatggcagccggcagtgtgaccgggaatatgactgcaaggacatgagcgatgaagttggctgcgttaatggtgagcgctg

SEQ ID NO: 3777 - DNA, 121 bp, Homo sapiens
cagcgctcaccattaacgcagccaacttcatcgctcatgtccttgcagtcatattcccggtcacactgccggctgccatggatgcagtttccatcagagcactggaattcgtcagggcgac

SEQ ID NO: 3778 - DNA, 17 bp, Homo sapiens
gcagtgtgaccgggaat

SEQ ID NO: 3779 - DNA, 17 bp, Homo sapiens
attcccggtcacactgc

SEQ ID NO: 3780 - DNA, 121 bp, Homo sapiens
cctgacgaattccagtgctctgatggaaactgcatccatggcagccggcagtgtgaccgggaatatgactgcaaggacatgagcgatgaagttggctgcgttaatggtgagcgctggccat

SEQ ID NO: 3781 - DNA, 121 bp, Homo sapiens
atggccagcgctcaccattaacgcagccaacttcatcgctcatgtccttgcagtcatattcccggtcacactgccggctgccatggatgcagtttccatcagagcactggaattcgtcagg

SEQ ID NO: 3782 - DNA, 17 bp, Homo sapiens
gtgaccgggaatatgac

SEQ ID NO: 3783 - DNA, 17 bp, Homo sapiens
gtcatattcccggtcac

SEQ ID NO: 3784 - DNA, 121 bp, Homo sapiens
tccagtgctctgatggaaactgcatccatggcagccggcagtgtgaccgggaatatgactgcaaggacatgagcgatgaagttggctgcgttaatggtgagcgctggccatctggttttcc

SEQ ID NO: 3785 - DNA, 121 bp, Homo sapiens
ggaaaaccagatggccagcgctcaccattaacgcagccaacttcatcgctcatgtccttgcagtcatattcccggtcacactgccggctgccatggatgcagtttccatcagagcactgga

SEQ ID NO: 3786 - DNA, 17 bp, Homo sapiens
atatgactgcaaggaca

SEQ ID NO: 3787 - DNA, 17 bp, Homo sapiens
tgtccttgcagtcatat

SEQ ID NO: 3788 - DNA, 121 bp, Homo sapiens
aaactgcatccatggcagccggcagtgtgaccgggaatatgactgcaaggacatgagcgatgaagttggctgcgttaatggtgagcgctggccatctggttttccatcccccattctctgt

SEQ ID NO: 3789 - DNA, 121 bp, Homo sapiens
acagagaatgggggatggaaaaccagatggccagcgctcaccattaacgcagccaacttcatcgctcatgtccttgcagtcatattcccggtcacactgccggctgccatggatgcagttt

SEQ ID NO: 3790 - DNA, 17 bp, Homo sapiens
atgagcgatgaagttgg

SEQ ID NO: 3791 - DNA, 17 bp, Homo sapiens
ccaacttcatcgctcat

SEQ ID NO: 3792 - DNA, 121 bp, Homo sapiens
atggcagccggcagtgtgaccgggaatatgactgcaaggacatgagcgatgaagttggctgcgttaatggtgagcgctggccatctggttttccatcccccattctctgtgccttgctgct

SEQ ID NO: 3793 - DNA, 121 bp, Homo sapiens
agcagcaaggcacagagaatgggggatggaaaaccagatggccagcgctcaccattaacgcagccaacttcatcgctcatgtccttgcagtcatattcccggtcacactgccggctgccat

SEQ ID NO: 3794 - DNA, 17 bp, Homo sapiens
agttggctgcgttaatg

SEQ ID NO: 3795 - DNA, 17 bp, Homo sapiens
cattaacgcagccaact

SEQ ID NO: 3796 - DNA, 121 bp, Homo sapiens
aggctcagacacacctgaccttcctccttcctctctctggctctcacagtgacactctgcgagggacccaacaagttcaagtgtcacagcggcgaatgcatcaccctggacaaagtctgca

SEQ ID NO: 3797 - DNA, 121 bp, Homo sapiens
tgcagactttgtccagggtgatgcattcgccgctgtgacacttgaacttgttgggtccctcgcagagtgtcactgtgagagccagagagaggaaggaggaaggtcaggtgtgtctgagcct

SEQ ID NO: 3798 - DNA, 17 bp, Homo sapiens
cactctgcgagggaccc

SEQ ID NO: 3799 - DNA, 17 bp, Homo sapiens
gggtccctcgcagagtg

SEQ ID NO: 3800 - DNA, 121 bp, Homo sapiens
cctctctctggctctcacagtgacactctgcgagggacccaacaagttcaagtgtcacagcggcgaatgcatcaccctggacaaagtctgcaacatggctagagactgccgggactggtca

SEQ ID NO: 3801 - DNA, 121 bp, Homo sapiens
tgaccagtcccggcagtctctagccatgttgcagactttgtccagggtgatgcattcgccgctgtgacacttgaacttgttgggtccctcgcagagtgtcactgtgagagccagagagagg

SEQ ID NO: 3802 - DNA, 17 bp, Homo sapiens
tgtcacagcggcgaatg

SEQ ID NO: 3803 - DNA, 17 bp, Homo sapiens
cattcgccgctgtgaca

SEQ ID NO: 3804 - DNA, 121 bp, Homo sapiens
tctctggctctcacagtgacactctgcgagggacccaacaagttcaagtgtcacagcggcgaatgcatcaccctggacaaagtctgcaacatggctagagactgccgggactggtcagatg

SEQ ID NO: 3805 - DNA, 121 bp, Homo sapiens
catctgaccagtcccggcagtctctagccatgttgcagactttgtccagggtgatgcattcgccgctgtgacacttgaacttgttgggtccctcgcagagtgtcactgtgagagccagaga

SEQ ID NO: 3806 - DNA, 17 bp, Homo sapiens
acagcggcgaatgcatc

SEQ ID NO: 3807 - DNA, 17 bp, Homo sapiens
gatgcattcgccgctgt

SEQ ID NO: 3808 - DNA, 121 bp, Homo sapiens; identical to SEQ ID NO: 3804

SEQ ID NO: 3809 - DNA, 121 bp, Homo sapiens; identical to SEQ ID NO: 3805

SEQ ID NO: 3810 - DNA, 17 bp, Homo sapiens
acagcggcgaatgcatc

SEQ ID NO: 3811 - DNA, 17 bp, Homo sapiens
gatgcattcgccgctgt

SEQ ID NO: 3812 - DNA, 121 bp, Homo sapiens
acactctgcgagggacccaacaagttcaagtgtcacagcggcgaatgcatcaccctggacaaagtctgcaacatggctagagactgccgggactggtcagatgaacccatcaaagagtgcg

SEQ ID NO: 3813 - DNA, 121 bp, Homo sapiens
cgcactctttgatgggttcatctgaccagtcccggcagtctctagccatgttgcagactttgtccagggtgatgcattcgccgctgtgacacttgaacttgttgggtccctcgcagagtgt

SEQ ID NO: 3814 - DNA, 17 bp, Homo sapiens
ccctggacaaagtctgc

SEQ ID NO: 3815 - DNA, 17 bp, Homo sapiens
gcagactttgtccaggg

SEQ ID NO: 3816 - DNA, 121 bp, Homo sapiens
cgagggacccaacaagttcaagtgtcacagcggcgaatgcatcaccctggacaaagtctgcaacatggctagagactgccgggactggtcagatgaacccatcaaagagtgcggtgagtct

SEQ ID NO: 3817 - DNA, 121 bp, Homo sapiens
agactcaccgcactctttgatgggttcatctgaccagtcccggcagtctctagccatgttgcagactttgtccagggtgatgcattcgccgctgtgacacttgaacttgttgggtccctcg

SEQ ID NO: 3818 - DNA, 17 bp, Homo sapiens
aaagtctgcaacatggc

SEQ ID NO: 3819 - DNA, 17 bp, Homo sapiens
gccatgttgcagacttt

SEQ ID NO: 3820 - DNA, 121 bp, Homo sapiens
agttcaagtgtcacagcggcgaatgcatcaccctggacaaagtctgcaacatggctagagactgccgggactggtcagatgaacccatcaaagagtgcggtgagtctcggtgcaggcggct

SEQ ID NO: 3821 - DNA, 121 bp, Homo sapiens
agccgcctgcaccgagactcaccgcactctttgatgggttcatctgaccagtcccggcagtctctagccatgttgcagactttgtccagggtgatgcattcgccgctgtgacacttgaact

SEQ ID NO: 3822 - DNA, 17 bp, Homo sapiens
ggctagagactgccggg

SEQ ID NO: 3823 - DNA, 17 bp, Homo sapiens
cccggcagtctctagcc

SEQ ID NO: 3824 - DNA, 121 bp, Homo sapiens
tcaagtgtcacagcggcgaatgcatcaccctggacaaagtctgcaacatggctagagactgccgggactggtcagatgaacccatcaaagagtgcggtgagtctcggtgcaggcggcttgc

SEQ ID NO: 3825 - DNA, 121 bp, Homo sapiens
gcaagccgcctgcaccgagactcaccgcactctttgatgggttcatctgaccagtcccggcagtctctagccatgttgcagactttgtccagggtgatgcattcgccgctgtgacacttga

SEQ ID NO: 3826 - DNA, 17 bp, Homo sapiens
tagagactgccgggact

SEQ ID NO: 3827 - DNA, 17 bp, Homo sapiens
agtcccggcagtctcta

SEQ ID NO: 3828 - DNA, 121 bp, Homo sapiens
tgtcacagcggcgaatgcatcaccctggacaaagtctgcaacatggctagagactgccgggactggtcagatgaacccatcaaagagtgcggtgagtctcggtgcaggcggcttgcagagt

SEQ ID NO: 3829 - DNA, 121 bp, Homo sapiens
actctgcaagccgcctgcaccgagactcaccgcactctttgatgggttcatctgaccagtcccggcagtctctagccatgttgcagactttgtccagggtgatgcattcgccgctgtgaca

SEQ ID NO: 3830 - DNA, 17 bp, Homo sapiens
actgccgggactggtca

SEQ ID NO: 3831 - DNA, 17 bp, Homo sapiens
tgaccagtcccggcagt

SEQ ID NO: 3832 - DNA, 121 bp, Homo sapiens
tcacagcggcgaatgcatcaccctggacaaagtctgcaacatggctagagactgccgggactggtcagatgaacccatcaaagagtgcggtgagtctcggtgcaggcggcttgcagagttt

SEQ ID NO: 3833 - DNA, 121 bp, Homo sapiens
aaactctgcaagccgcctgcaccgagactcaccgcactctttgatgggttcatctgaccagtcccggcagtctctagccatgttgcagactttgtccagggtgatgcattcgccgctgtga

SEQ ID NO: 3834 - DNA, 17 bp, Homo sapiens
tgccgggactggtcaga

SEQ ID NO: 3835 - DNA, 17 bp, Homo sapiens
tctgaccagtcccggca

SEQ ID NO: 3836 - DNA, 121 bp, Homo sapiens; identical to SEQ ID NO: 3828

SEQ ID NO: 3837 - DNA, 121 bp, Homo sapiens; identical to SEQ ID NO: 3829

SEQ ID NO: 3838 - DNA, 17 bp, Homo sapiens
actgccgggactggtca

SEQ ID NO: 3839 - DNA, 17 bp, Homo sapiens
tgaccagtcccggcagt

SEQ ID NO: 3840 - DNA, 121 bp, Homo sapiens
cagcggcgaatgcatcaccctggacaaagtctgcaacatggctagagactgccgggactggtcagatgaacccatcaaagagtgcggtgagtctcggtgcaggcggcttgcagagtttgtg

SEQ ID NO: 3841 - DNA, 121 bp, Homo sapiens
cacaaactctgcaagccgcctgcaccgagactcaccgcactctttgatgggttcatctgaccagtcccggcagtctctagccatgttgcagactttgtccagggtgatgcattcgccgctg

SEQ ID NO: 3842 - DNA, 17 bp, Homo sapiens
cgggactggtcagatga

SEQ ID NO: 3843 - DNA, 17 bp, Homo sapiens
tcatctgaccagtcccg

SEQ ID NO: 3844 - DNA, 121 bp, Homo sapiens
gcggcgaatgcatcaccctggacaaagtctgcaacatggctagagactgccgggactggtcagatgaacccatcaaagagtgcggtgagtctcggtgcaggcggcttgcagagtttgtggg

SEQ ID NO: 3845 - DNA, 121 bp, Homo sapiens
cccacaaactctgcaagccgcctgcaccgagactcaccgcactctttgatgggttcatctgaccagtcccggcagtctctagccatgttgcagactttgtccagggtgatgcattcgccgc

SEQ ID NO: 3846 - DNA, 17 bp, Homo sapiens
ggactggtcagatgaac

SEQ ID NO: 3847 - DNA, 17 bp, Homo sapiens
gttcatctgaccagtcc

SEQ ID NO: 3848 - DNA, 121 bp, Homo sapiens
ccctggacaaagtctgcaacatggctagagactgccgggactggtcagatgaacccatcaaagagtgcggtgagtctcggtgcaggcggcttgcagagtttgtggggagccaggaaaggga

SEQ ID NO: 3849 - DNA, 121 bp, Homo sapiens
tccctttcctggctccccacaaactctgcaagccgcctgcaccgagactcaccgcactctttgatgggttcatctgaccagtcccggcagtctctagccatgttgcagactttgtccaggg

SEQ ID NO: 3850 - DNA, 17 bp, Homo sapiens
acccatcaaagagtgcg

SEQ ID NO: 3851 - DNA, 17 bp, Homo sapiens
cgcactctttgatgggt

SEQ ID NO: 3852 - DNA, 121 bp, Homo sapiens
gggtaggggcccgagagtgaccagtctgcatcccctggccctgcgcagggaccaacgaatgcttggacaacaacggcggctgttcccacgtctgcaatgaccttaagatcggctacgagtg

SEQ ID NO: 3853 - DNA, 121 bp, Homo sapiens
cactcgtagccgatcttaaggtcattgcagacgtgggaacagccgccgttgttgtccaagcattcgttggtccctgcgcagggccaggggatgcagactggtcactctcgggcccctaccc

SEQ ID NO: 3854 - DNA, 17 bp, Homo sapiens
caacgaatgcttggaca

SEQ ID NO: 3855 - DNA, 17 bp, Homo sapiens
tgtccaagcattcgttg

SEQ ID NO: 3856 - DNA, 121 bp, Homo sapiens; identical to SEQ ID NO: 3852

SEQ ID NO: 3857 - DNA, 121 bp, Homo sapiens; identical to SEQ ID NO: 3853

SEQ ID NO: 3858 - DNA, 17 bp, Homo sapiens
caacgaatgcttggaca

SEQ ID NO: 3859 - DNA, 17 bp, Homo sapiens
tgtccaagcattcgttg

SEQ ID NO: 3860 - DNA, 121 bp, Homo sapiens
tgcatcccctggccctgcgcagggaccaacgaatgcttggacaacaacggcggctgttcccacgtctgcaatgaccttaagatcggctacgagtgcctgtgccccgacggcttccagctgg

SEQ ID NO: 3861 - DNA, 121 bp, Homo sapiens
ccagctggaagccgtcggggcacaggcactcgtagccgatcttaaggtcattgcagacgtgggaacagccgccgttgttgtccaagcattcgttggtccctgcgcagggccaggggatgca

SEQ ID NO: 3862 - DNA, 17 bp, Homo sapiens
gctgttcccacgtctgc

SEQ ID NO: 3863 - DNA, 17 bp, Homo sapiens
gcagacgtgggaacagc

SEQ ID NO: 3864 - DNA, 121 bp, Homo sapiens
ccctggccctgcgcagggaccaacgaatgcttggacaacaacggcggctgttcccacgtctgcaatgaccttaagatcggctacgagtgcctgtgccccgacggcttccagctggtggccc

SEQ ID NO: 3865 - DNA, 121 bp, Homo sapiens
gggccaccagctggaagccgtcggggcacaggcactcgtagccgatcttaaggtcattgcagacgtgggaacagccgccgttgttgtccaagcattcgttggtccctgcgcagggccaggg

SEQ ID NO: 3866 - DNA, 17 bp, Homo sapiens
cccacgtctgcaatgac

SEQ ID NO: 3867 - DNA, 17 bp, Homo sapiens
gtcattgcagacgtggg

SEQ ID NO: 3868 - DNA, 121 bp, Homo sapiens
cctggccctgcgcagggaccaacgaatgcttggacaacaacggcggctgttcccacgtctgcaatgaccttaagatcggctacgagtgcctgtgccccgacggcttccagctggtggccca

SEQ ID NO: 3869 - DNA, 121 bp, Homo sapiens
tgggccaccagctggaagccgtcggggcacaggcactcgtagccgatcttaaggtcattgcagacgtgggaacagccgccgttgttgtccaagcattcgttggtccctgcgcagggccagg

SEQ ID NO: 3870 - DNA, 17 bp, Homo sapiens
ccacgtctgcaatgacc

SEQ ID NO: 3871 - DNA, 17 bp, Homo sapiens
ggtcattgcagacgtgg

SEQ ID NO: 3872 - DNA, 121 bp, Homo sapiens
accaacgaatgcttggacaacaacggcggctgttcccacgtctgcaatgaccttaagatcggctacgagtgcctgtgccccgacggcttccagctggtggcccagcgaagatgcgaaggtg

SEQ ID NO: 3873 - DNA, 121 bp, Homo sapiens
caccttcgcatcttcgctgggccaccagctggaagccgtcggggcacaggcactcgtagccgatcttaaggtcattgcagacgtgggaacagccgccgttgttgtccaagcattcgttggt

SEQ ID NO: 3874 - DNA, 17 bp, Homo sapiens
ttaagatcggctacgag

SEQ ID NO: 3875 - DNA, 17 bp, Homo sapiens
ctcgtagccgatcttaa

SEQ ID NO: 3876 - DNA, 121 bp, Homo sapiens
ccaacgaatgcttggacaacaacggcggctgttcccacgtctgcaatgaccttaagatcggctacgagtgcctgtgccccgacggcttccagctggtggcccagcgaagatgcgaaggtga

SEQ ID NO: 3877 - DNA, 121 bp, Homo sapiens
tcaccttcgcatcttcgctgggccaccagctggaagccgtcggggcacaggcactcgtagccgatcttaaggtcattgcagacgtgggaacagccgccgttgttgtccaagcattcgttgg

SEQ ID NO: 3878 - DNA, 17 bp, Homo sapiens
taagatcggctacgagt

SEQ ID NO: 3879 - DNA, 17 bp, Homo sapiens
actcgtagccgatctta

SEQ ID NO: 3880 - DNA, 121 bp, Homo sapiens
cgaatgcttggacaacaacggcggctgttcccacgtctgcaatgaccttaagatcggctacgagtgcctgtgccccgacggcttccagctggtggcccagcgaagatgcgaaggtgatttc

SEQ ID NO: 3881 - DNA, 121 bp, Homo sapiens
gaaatcaccttcgcatcttcgctgggccaccagctggaagccgtcggggcacaggcactcgtagccgatcttaaggtcattgcagacgtgggaacagccgccgttgttgtccaagcattcg

SEQ ID NO: 3882 - DNA, 17 bp, Homo sapiens
atcggctacgagtgcct

SEQ ID NO: 3883 - DNA, 17 bp, Homo sapiens
aggcactcgtagccgat

SEQ ID NO: 3884 - DNA, 121 bp, Homo sapiens
tgcttggacaacaacggcggctgttcccacgtctgcaatgaccttaagatcggctacgagtgcctgtgccccgacggcttccagctggtggcccagcgaagatgcgaaggtgatttccggg

SEQ ID NO: 3885 - DNA, 121 bp, Homo sapiens
cccggaaatcaccttcgcatcttcgctgggccaccagctggaagccgtcggggcacaggcactcgtagccgatcttaaggtcattgcagacgtgggaacagccgccgttgttgtccaagca

SEQ ID NO: 3886 - DNA, 17 bp, Homo sapiens
gctacgagtgcctgtgc

SEQ ID NO: 3887 - DNA, 17 bp, Homo sapiens
gcacaggcactcgtagc

SEQ ID NO: 3888 - DNA, 121 bp, Homo sapiens; identical to SEQ ID NO: 3884

SEQ ID NO: 3889 - DNA, 121 bp, Homo sapiens; identical to SEQ ID NO: 3885

SEQ ID NO: 3890 - DNA, 17 bp, Homo sapiens
gctacgagtgcctgtgc

SEQ ID NO: 3891 - DNA, 17 bp, Homo sapiens
gcacaggcactcgtagc

SEQ ID NO: 3892 - DNA, 121 bp, Homo sapiens
acaacggcggctgttcccacgtctgcaatgaccttaagatcggctacgagtgcctgtgccccgacggcttccagctggtggcccagcgaagatgcgaaggtgatttccgggtgggactgag

SEQ ID NO: 3893 - DNA, 121 bp, Homo sapiens
ctcagtcccacccggaaatcaccttcgcatcttcgctgggccaccagctggaagccgtcggggcacaggcactcgtagccgatcttaaggtcattgcagacgtgggaacagccgccgttgt

SEQ ID NO: 3894 - DNA, 17 bp, Homo sapiens
cctgtgccccgacggct

SEQ ID NO: 3895 - DNA, 17 bp, Homo sapiens
agccgtcggggcacagg

SEQ ID NO: 3896 - DNA, 121 bp, Homo sapiens
aacggcggctgttcccacgtctgcaatgaccttaagatcggctacgagtgcctgtgccccgacggcttccagctggtggcccagcgaagatgcgaaggtgatttccgggtgggactgagcc

SEQ ID NO: 3897 - DNA, 121 bp, Homo sapiens
ggctcagtcccacccggaaatcaccttcgcatcttcgctgggccaccagctggaagccgtcggggcacaggcactcgtagccgatcttaaggtcattgcagacgtgggaacagccgccgtt

SEQ ID NO: 3898 - DNA, 17 bp, Homo sapiens
tgtgccccgacggcttc

SEQ ID NO: 3899 - DNA, 17 bp, Homo sapiens
gaagccgtcggggcaca

SEQ ID NO: 3900 - DNA, 121 bp, Homo sapiens
cggcggctgttcccacgtctgcaatgaccttaagatcggctacgagtgcctgtgccccgacggcttccagctggtggcccagcgaagatgcgaaggtgatttccgggtgggactgagccct

SEQ ID NO: 3901 - DNA, 121 bp, Homo sapiens
agggctcagtcccacccggaaatcaccttcgcatcttcgctgggccaccagctggaagccgtcggggcacaggcactcgtagccgatcttaaggtcattgcagacgtgggaacagccgccg

SEQ ID NO: 3902 - DNA, 17 bp, Homo sapiens
tgccccgacggcttcca

SEQ ID NO: 3903 - DNA, 17 bp, Homo sapiens
tggaagccgtcggggca

SEQ ID NO: 3904 - DNA, 121 bp, Homo sapiens
ggcggctgttcccacgtctgcaatgaccttaagatcggctacgagtgcctgtgccccgacggcttccagctggtggcccagcgaagatgcgaaggtgatttccgggtgggactgagccctg

SEQ ID NO: 3905 - DNA, 121 bp, Homo sapiens
cagggctcagtcccacccggaaatcaccttcgcatcttcgctgggccaccagctggaagccgtcggggcacaggcactcgtagccgatcttaaggtcattgcagacgtgggaacagccgcc

SEQ ID NO: 3906 - DNA, 17 bp, Homo sapiens
gccccgacggcttccag

SEQ ID NO: 3907 - DNA, 17 bp, Homo sapiens
ctggaagccgtcggggc

SEQ ID NO: 3908 - DNA, 121 bp, Homo sapiens
tgttcccacgtctgcaatgaccttaagatcggctacgagtgcctgtgccccgacggcttccagctggtggcccagcgaagatgcgaaggtgatttccgggtgggactgagccctgggcccc

SEQ ID NO: 3909 - DNA, 121 bp, Homo sapiens
ggggcccagggctcagtcccacccggaaatcaccttcgcatcttcgctgggccaccagctggaagccgtcggggcacaggcactcgtagccgatcttaaggtcattgcagacgtgggaaca

SEQ ID NO: 3910 - DNA, 17 bp, Homo sapiens
acggcttccagctggtg

SEQ ID NO: 3911 - DNA, 17 bp, Homo sapiens
caccagctggaagccgt

SEQ ID NO: 3912 - DNA, 121 bp, Homo sapiens
atgaccttaagatcggctacgagtgcctgtgccccgacggcttccagctggtggcccagcgaagatgcgaaggtgatttccgggtgggactgagccctgggccccctctgcgcttcctgac

SEQ ID NO: 3913 - DNA, 121 bp, Homo sapiens
gtcaggaagcgcagagggggcccagggctcagtcccacccggaaatcaccttcgcatcttcgctgggccaccagctggaagccgtcggggcacaggcactcgtagccgatcttaaggtcat

SEQ ID NO: 3914 - DNA, 17 bp, Homo sapiens
ggcccagcgaagatgcg

SEQ ID NO: 3915 - DNA, 17 bp, Homo sapiens
cgcatcttcgctgggcc

SEQ ID NO: 3916 - DNA, 121 bp, Homo sapiens
aatgaccttaagatcggctacgagtgcctgtgccccgacggcttccagctggtggcccagcgaagatgcgaaggtgatttccgggtgggactgagccctgggccccctctgcgcttcctga

SEQ ID NO: 3917 - DNA, 121 bp, Homo sapiens
tcaggaagcgcagagggggcccagggctcagtcccacccggaaatcaccttcgcatcttcgctgggccaccagctggaagccgtcggggcacaggcactcgtagccgatcttaaggtcatt

SEQ ID NO: 3918 - DNA, 17 bp, Homo sapiens
tggcccagcgaagatgc

SEQ ID NO: 3919 - DNA, 17 bp, Homo sapiens
gcatcttcgctgggcca

SEQ ID NO: 3920 - DNA, 121 bp, Homo sapiens
tctagccattggggaagagcctccccaccaagcctctttctctctcttccagatatcgatgagtgtcaggatcccgacacctgcagccagctctgcgtgaacctggagggtggctacaagt

SEQ ID NO: 3921 - DNA, 121 bp, Homo sapiens
acttgtagccaccctccaggttcacgcagagctggctgcaggtgtcgggatcctgacactcatcgatatctggaagagagagaaagaggcttggtggggaggctcttccccaatggctaga

SEQ ID NO: 3922 - DNA, 17 bp, Homo sapiens
atatcgatgagtgtcag

SEQ ID NO: 3923 - DNA, 17 bp, Homo sapiens
ctgacactcatcgatat

SEQ ID NO: 3924 - DNA, 121 bp, Homo sapiens
cattggggaagagcctccccaccaagcctctttctctctcttccagatatcgatgagtgtcaggatcccgacacctgcagccagctctgcgtgaacctggagggtggctacaagtgccagt

SEQ ID NO: 3925 - DNA, 121 bp, Homo sapiens
actggcacttgtagccaccctccaggttcacgcagagctggctgcaggtgtcgggatcctgacactcatcgatatctggaagagagagaaagaggcttggtggggaggctcttccccaatg

SEQ ID NO: 3926 - DNA, 17 bp, Homo sapiens
atgagtgtcaggatccc

SEQ ID NO: 3927 - DNA, 17 bp, Homo sapiens
gggatcctgacactcat

SEQ ID NO: 3928 - DNA, 121 bp, Homo sapiens
tccccaccaagcctctttctctctcttccagatatcgatgagtgtcaggatcccgacacctgcagccagctctgcgtgaacctggagggtggctacaagtgccagtgtgaggaaggcttcc

SEQ ID NO: 3929 - DNA, 121 bp, Homo sapiens
ggaagccttcctcacactggcacttgtagccaccctccaggttcacgcagagctggctgcaggtgtcgggatcctgacactcatcgatatctggaagagagagaaagaggcttggtgggga

SEQ ID NO: 3930 - DNA, 17 bp, Homo sapiens
ccgacacctgcagccag

SEQ ID NO: 3931 - DNA, 17 bp, Homo sapiens
ctggctgcaggtgtcgg

SEQ ID NO: 3932 - DNA, 121 bp, Homo sapiens
caagcctctttctctctcttccagatatcgatgagtgtcaggatcccgacacctgcagccagctctgcgtgaacctggagggtggctacaagtgccagtgtgaggaaggcttccagctgga

SEQ ID NO: 3933 - DNA, 121 bp, Homo sapiens
tccagctggaagccttcctcacactggcacttgtagccaccctccaggttcacgcagagctggctgcaggtgtcgggatcctgacactcatcgatatctggaagagagagaaagaggcttg

SEQ ID NO: 3934 - DNA, 17 bp, Homo sapiens
ctgcagccagctctgcg

SEQ ID NO: 3935 - DNA, 17 bp, Homo sapiens
cgcagagctggctgcag

SEQ ID NO: 3936 - DNA, 121 bp, Homo sapiens
tctttctctctcttccagatatcgatgagtgtcaggatcccgacacctgcagccagctctgcgtgaacctggagggtggctacaagtgccagtgtgaggaaggcttccagctggaccccca

SEQ ID NO: 3937 - DNA, 121 bp, Homo sapiens
tgggggtccagctggaagccttcctcacactggcacttgtagccaccctccaggttcacgcagagctggctgcaggtgtcgggatcctgacactcatcgatatctggaagagagagaaaga

SEQ ID NO: 3938 - DNA, 17 bp, Homo sapiens
ccagctctgcgtgaacc

SEQ ID NO: 3939 - DNA, 17 bp, Homo sapiens
ggttcacgcagagctgg

SEQ ID NO: 3940 - DNA, 121 bp, Homo sapiens
ctctttctctctcttccagatatcgatgagtgtcaggatcccgacacctgcagccagctctgcgtgaacctggagggtggctacaagtgccagtgtgaggaaggcttccagctggaccccc

SEQ ID NO: 3941 - DNA, 121 bp, Homo sapiens
gggggtccagctggaagccttcctcacactggcacttgtagccaccctccaggttcacgcagagctggctgcaggtgtcgggatcctgacactcatcgatatctggaagagagagaaagag

SEQ ID NO: 3942 - DNA, 17 bp, Homo sapiens
gccagctctgcgtgaac

SEQ ID NO: 3943 - DNA, 17 bp, Homo sapiens
gttcacgcagagctggc

SEQ ID NO: 3944 - DNA, 121 bp, Homo sapiens
cagatatcgatgagtgtcaggatcccgacacctgcagccagctctgcgtgaacctggagggtggctacaagtgccagtgtgaggaaggcttccagctggacccccacacgaaggcctgcaa

SEQ ID NO: 3945 - DNA, 121 bp, Homo sapiens
ttgcaggccttcgtgtgggggtccagctggaagccttcctcacactggcacttgtagccaccctccaggttcacgcagagctggctgcaggtgtcgggatcctgacactcatcgatatctg

SEQ ID NO: 3946 - DNA, 17 bp, Homo sapiens
cctggagggtggctaca

SEQ ID NO: 3947 - DNA, 17 bp, Homo sapiens
tgtagccaccctccagg

SEQ ID NO: 3948 - DNA, 121 bp, Homo sapiens
tcgatgagtgtcaggatcccgacacctgcagccagctctgcgtgaacctggagggtggctacaagtgccagtgtgaggaaggcttccagctggacccccacacgaaggcctgcaaggctgt

SEQ ID NO: 3949 - DNA, 121 bp, Homo sapiens
acagccttgcaggccttcgtgtgggggtccagctggaagccttcctcacactggcacttgtagccaccctccaggttcacgcagagctggctgcaggtgtcgggatcctgacactcatcga

SEQ ID NO: 3950 - DNA, 17 bp, Homo sapiens
gggtggctacaagtgcc

SEQ ID NO: 3951 - DNA, 17 bp, Homo sapiens
ggcacttgtagccaccc

SEQ ID NO: 3952 - DNA, 121 bp, Homo sapiens
caggatcccgacacctgcagccagctctgcgtgaacctggagggtggctacaagtgccagtgtgaggaaggcttccagctggacccccacacgaaggcctgcaaggctgtgggtgagcacg

SEQ ID NO: 3953 - DNA, 121 bp, Homo sapiens
cgtgctcacccacagccttgcaggccttcgtgtgggggtccagctggaagccttcctcacactggcacttgtagccaccctccaggttcacgcagagctggctgcaggtgtcgggatcctg

SEQ ID NO: 3954 - DNA, 17 bp, Homo sapiens
agtgccagtgtgaggaa

SEQ ID NO: 3955 - DNA, 17 bp, Homo sapiens
ttcctcacactggcact

SEQ ID NO: 3956 - DNA, 121 bp, Homo sapiens
tgcagccagctctgcgtgaacctggagggtggctacaagtgccagtgtgaggaaggcttccagctggacccccacacgaaggcctgcaaggctgtgggtgagcacgggaaggcggcgggtg

SEQ ID NO: 3957 - DNA, 121 bp, Homo sapiens
cacccgccgccttcccgtgctcacccacagccttgcaggccttcgtgtgggggtccagctggaagccttcctcacactggcacttgtagccaccctccaggttcacgcagagctggctgca

SEQ ID NO: 3958 - DNA, 17 bp, Homo sapiens
aaggcttccagctggac

SEQ ID NO: 3959 - DNA, 17 bp, Homo sapiens
gtccagctggaagcctt

SEQ ID NO: 3960 - DNA, 121 bp, Homo sapiens
gcaggagcaaaggcgccatggctgtggagtcccagggcggacgcccacttgtcctgggcctgctgctgtgtgtgctgggcccagtggtgtcccatgctgggaagatactgttgatcccagt

SEQ ID NO: 3961 - DNA, 121 bp, Homo sapiens
actgggatcaacagtatcttcccagcatgggacaccactgggcccagcacacacagcagcaggcccaggacaagtgggcgtccgccctgggactccacagccatggcgcctttgctcctgc

SEQ ID NO: 3962 - DNA, 17 bp, Homo sapiens
cctgggcctgctgctgt

SEQ ID NO: 3963 - DNA, 17 bp, Homo sapiens
acagcagcaggcccagg

SEQ ID NO: 3964 - DNA, 121 bp, Homo sapiens
gggaagatactgttgatcccagtggatggcagccactggctgagcatgcttggggccatccagcagctgcagcagaggggacatgaaatagttgtcctagcacctgacgcctcgttgtaca

SEQ ID NO: 3965 - DNA, 121 bp, Homo sapiens
tgtacaacgaggcgtcaggtgctaggacaactatttcatgtcccctctgctgcagctgctggatggccccaagcatgctcagccagtggctgccatccactgggatcaacagtatcttccc

SEQ ID NO: 3966 - DNA, 17 bp, Homo sapiens
gggccatccagcagctg

SEQ ID NO: 3967 - DNA, 17 bp, Homo sapiens
cagctgctggatggccc

SEQ ID NO: 3968 - DNA, 121 bp, Homo sapiens
cagcagaggggacatgaaatagttgtcctagcacctgacgcctcgttgtacatcagagacggagcattttacaccttgaagacgtaccctgtgccattccaaagggaggatgtgaaagagt

SEQ ID NO: 3969 - DNA, 121 bp, Homo sapiens
actctttcacatcctccctttggaatggcacagggtacgtcttcaaggtgtaaaatgctccgtctctgatgtacaacgaggcgtcaggtgctaggacaactatttcatgtcccctctgctg

SEQ ID NO: 3970 - DNA, 17 bp, Homo sapiens
tcagagacggagcattt

SEQ ID NO: 3971 - DNA, 17 bp, Homo sapiens
aaatgctccgtctctga

SEQ ID NO: 3972 - DNA, 121 bp, Homo sapiens
gggtgaagaacatgctcattgccttttcacagaactttctgtgcgacgtggtttattccccgtatgcaacccttgcctcagaattccttcagagagaggtgactgtccaggacctattgag

SEQ ID NO: 3973 - DNA, 121 bp, Homo sapiens
ctcaataggtcctggacagtcacctctctctgaaggaattctgaggcaagggttgcatacggggaataaaccacgtcgcacagaaagttctgtgaaaaggcaatgagcatgttcttcaccc

SEQ ID NO: 3974 - DNA, 17 bp, Homo sapiens
ttattccccgtatgcaa

SEQ ID NO: 3975 - DNA, 17 bp, Homo sapiens
ttgcatacggggaataa

SEQ ID NO: 3976 - DNA, 121 bp, Homo sapiens
tgtgaaggattaccctaggcccatcatgcccaatatggtttttgttggtggaatcaactgccttcaccaaaatccactatcccaggtgtgtattggagtgggacttttacatgcgtatatt

SEQ ID NO: 3977 - DNA, 121 bp, Homo sapiens
aatatacgcatgtaaaagtcccactccaatacacacctgggatagtggattttggtgaaggcagttgattccaccaacaaaaaccatattgggcatgatgggcctagggtaatccttcaca

SEQ ID NO: 3978 - DNA, 17 bp, Homo sapiens
atcaactgccttcacca

SEQ ID NO: 3979 - DNA, 17 bp, Homo sapiens
tggtgaaggcagttgat

SEQ ID NO: 3980 - DNA, 121 bp, Homo sapiens
atcaaagaatatgagaaaaaattaactgaaaatttttcttctggctctaggaatttgaagcctacattaatgcttctggagaacatggaattgtggttttctctttgggatcaatggtctc

SEQ ID NO: 3981 - DNA, 121 bp, Homo sapiens
gagaccattgatcccaaagagaaaaccacaattccatgttctccagaagcattaatgtaggcttcaaattcctagagccagaagaaaaattttcagttaattttttctcatattctttgat

SEQ ID NO: 3982 - DNA, 17 bp, Homo sapiens
atttgaagcctacatta

SEQ ID NO: 3983 - DNA, 17 bp, Homo sapiens
taatgtaggcttcaaat

SEQ ID NO: 3984 - DNA, 121 bp, Homo sapiens
aggaatttgaagcctacattaatgcttctggagaacatggaattgtggttttctctttgggatcaatggtctcagaaattccagagaagaaagctatggcaattgctgatgctttgggcaa

SEQ ID NO: 3985 - DNA, 121 bp, Homo sapiens
ttgcccaaagcatcagcaattgccatagctttcttctctggaatttctgagaccattgatcccaaagagaaaaccacaattccatgttctccagaagcattaatgtaggcttcaaattcct

SEQ ID NO: 3986 - DNA, 17 bp, Homo sapiens
ctctttgggatcaatgg

SEQ ID NO: 3987 - DNA, 17 bp, Homo sapiens
ccattgatcccaaagag

SEQ ID NO: 3988 - DNA, 121 bp, Homo sapiens
gtctcagaaattccagagaagaaagctatggcaattgctgatgctttgggcaaaatccctcagacagtaagaagattctataccatggcctcatatctattttcacaggagcgctaatccc

SEQ ID NO: 3989 - DNA, 121 bp, Homo sapiens
gggattagcgctcctgtgaaaatagatatgaggccatggtatagaatcttcttactgtctgagggattttgcccaaagcatcagcaattgccatagctttcttctctggaatttctgagac

SEQ ID NO: 3990 - DNA, 17 bp, Homo sapiens
aaatccctcagacagta

SEQ ID NO: 3991 - DNA, 17 bp, Homo sapiens
tactgtctgagggattt

SEQ ID NO: 3992 - DNA, 121 bp, Homo sapiens
tctaatcatattatgttctttctttacgttctgctctttttgcccctcccaggtcctgtggcggtacactggaacccgaccatcgaatcttgcgaacaacacgatacttgttaagtggcta

SEQ ID NO: 3993 - DNA, 121 bp, Homo sapiens
tagccacttaacaagtatcgtgttgttcgcaagattcgatggtcgggttccagtgtaccgccacaggacctgggaggggcaaaaagagcagaacgtaaagaaagaacataatatgattaga

SEQ ID NO: 3994 - DNA, 17 bp, Homo sapiens
gtcctgtggcggtacac

SEQ ID NO: 3995 - DNA, 17 bp, Homo sapiens
gtgtaccgccacaggac

SEQ ID NO: 3996 - DNA, 121 bp, Homo sapiens
acactggaacccgaccatcgaatcttgcgaacaacacgatacttgttaagtggctaccccaaaacgatctgcttggtatgttgggcggattggatgtataggtcaaaccagggtcaaatta

SEQ ID NO: 3997 - DNA, 121 bp, Homo sapiens
taatttgaccctggtttgacctatacatccaatccgcccaacataccaagcagatcgttttggggtagccacttaacaagtatcgtgttgttcgcaagattcgatggtcgggttccagtgt

SEQ ID NO: 3998 - DNA, 17 bp, Homo sapiens
gctaccccaaaacgatc

SEQ ID NO: 3999 - DNA, 17 bp, Homo sapiens
gatcgttttggggtagc

SEQ ID NO: 4000 - DNA, 121 bp, Homo sapiens
tacactggaacccgaccatcgaatcttgcgaacaacacgatacttgttaagtggctaccccaaaacgatctgcttggtatgttgggcggattggatgtataggtcaaaccagggtcaaatt

SEQ ID NO: 4001 - DNA, 121 bp, Homo sapiens
aatttgaccctggtttgacctatacatccaatccgcccaacataccaagcagatcgttttggggtagccacttaacaagtatcgtgttgttcgcaagattcgatggtcgggttccagtgta

SEQ ID NO: 4002 - DNA, 17 bp, Homo sapiens
ggctaccccaaaacgat

SEQ ID NO: 4003 - DNA, 17 bp, Homo sapiens
atcgttttggggtagcc

SEQ ID NO: 4004 - DNA, 121 bp, Homo sapiens
aactcagagatgtaactgctgacatcctccctattttgcatctcaggtcacccgatgacccgtgcctttatcacccatgctggttcccatggtgtttatgaaagcatatgcaatggcgttc

SEQ ID NO: 4005 - DNA, 121 bp, Homo sapiens
gaacgccattgcatatgctttcataaacaccatgggaaccagcatgggtgataaaggcacgggtcatcgggtgacctgagatgcaaaatagggaggatgtcagcagttacatctctgagtt

SEQ ID NO: 4006 - DNA, 17 bp, Homo sapiens
cgatgacccgtgccttt

SEQ ID NO: 4007 - DNA, 17 bp, Homo sapiens
aaaggcacgggtcatcg

SEQ ID NO: 4008 - DNA, 121 bp, Homo sapiens
tcagagatgtaactgctgacatcctccctattttgcatctcaggtcacccgatgacccgtgcctttatcacccatgctggttcccatggtgtttatgaaagcatatgcaatggcgttccca

SEQ ID NO: 4009 - DNA, 121 bp, Homo sapiens
tgggaacgccattgcatatgctttcataaacaccatgggaaccagcatgggtgataaaggcacgggtcatcgggtgacctgagatgcaaaatagggaggatgtcagcagttacatctctga

SEQ ID NO: 4010 - DNA, 17 bp, Homo sapiens
tgacccgtgcctttatc

SEQ ID NO: 4011 - DNA, 17 bp, Homo sapiens
gataaaggcacgggtca

SEQ ID NO: 4012 - DNA, 121 bp, Homo sapiens
cctccctattttgcatctcaggtcacccgatgacccgtgcctttatcacccatgctggttcccatggtgtttatgaaagcatatgcaatggcgttcccatggtgatgatgcccttgtttgg

SEQ ID NO: 4013 - DNA, 121 bp, Homo sapiens
ccaaacaagggcatcatcaccatgggaacgccattgcatatgctttcataaacaccatgggaaccagcatgggtgataaaggcacgggtcatcgggtgacctgagatgcaaaatagggagg

SEQ ID NO: 4014 - DNA, 17 bp, Homo sapiens
tgctggttcccatggtg

SEQ ID NO: 4015 - DNA, 17 bp, Homo sapiens
caccatgggaaccagca

SEQ ID NO: 4016 - DNA, 121 bp, Homo sapiens
aggtcacccgatgacccgtgcctttatcacccatgctggttcccatggtgtttatgaaagcatatgcaatggcgttcccatggtgatgatgcccttgtttggtgatcagatggacaatgca

SEQ ID NO: 4017 - DNA, 121 bp, Homo sapiens
tgcattgtccatctgatcaccaaacaagggcatcatcaccatgggaacgccattgcatatgctttcataaacaccatgggaaccagcatgggtgataaaggcacgggtcatcgggtgacct

SEQ ID NO: 4018 - DNA, 17 bp, Homo sapiens
tatgaaagcatatgcaa

SEQ ID NO: 4019 - DNA, 17 bp, Homo sapiens
ttgcatatgctttcata

SEQ ID NO: 4020 - DNA, 121 bp, Homo sapiens
agcatatgcaatggcgttcccatggtgatgatgcccttgtttggtgatcagatggacaatgcaaagcgcatggagactaagggagctggagtgaccctgaatgttctggaaatgacttctg

SEQ ID NO: 4021 - DNA, 121 bp, Homo sapiens
cagaagtcatttccagaacattcagggtcactccagctcccttagtctccatgcgctttgcattgtccatctgatcaccaaacaagggcatcatcaccatgggaacgccattgcatatgct

SEQ ID NO: 4022 - DNA, 17 bp, Homo sapiens
tggacaatgcaaagcgc

SEQ ID NO: 4023 - DNA, 17 bp, Homo sapiens
gcgctttgcattgtcca

SEQ ID NO: 4024 - DNA, 121 bp, Homo sapiens
ggagctggagtgaccctgaatgttctggaaatgacttctgaagatttagaaaatgctctaaaagcagtcatcaatgacaaaaggtaagaaagaagatacagaagaatactttggtcatggc

SEQ ID NO: 4025 - DNA, 121 bp, Homo sapiens
gccatgaccaaagtattcttctgtatcttctttcttaccttttgtcattgatgactgcttttagagcattttctaaatcttcagaagtcatttccagaacattcagggtcactccagctcc

SEQ ID NO: 4026 - DNA, 17 bp, Homo sapiens
atgctctaaaagcagtc

SEQ ID NO: 4027 - DNA, 17 bp, Homo sapiens
gactgcttttagagcat

SEQ ID NO: 4028 - DNA, 121 bp, Homo sapiens
atgaggcacaagggcgcgccacacctgcgccccgcagcccacgacctcacctggtaccagtaccattccttggacgtgattggtttcctcttggccgtcgtgctgacagtggccttcatca

SEQ ID NO: 4029 - DNA, 121 bp, Homo sapiens
tgatgaaggccactgtcagcacgacggccaagaggaaaccaatcacgtccaaggaatggtactggtaccaggtgaggtcgtgggctgcggggcgcaggtgtggcgcgcccttgtgcctcat

SEQ ID NO: 4030 - DNA, 17 bp, Homo sapiens
ggtaccagtaccattcc

SEQ ID NO: 4031 - DNA, 17 bp, Homo sapiens
ggaatggtactggtacc

SEQ ID NO: 4032 - DNA, 121 bp, Homo sapiens
acaagggcgcgccacacctgcgccccgcagcccacgacctcacctggtaccagtaccattccttggacgtgattggtttcctcttggccgtcgtgctgacagtggccttcatcacctttaa

SEQ ID NO: 4033 - DNA, 121 bp, Homo sapiens
ttaaaggtgatgaaggccactgtcagcacgacggccaagaggaaaccaatcacgtccaaggaatggtactggtaccaggtgaggtcgtgggctgcggggcgcaggtgtggcgcgcccttgt

SEQ ID NO: 4034 - DNA, 17 bp, Homo sapiens
gtaccattccttggacg

SEQ ID NO: 4035 - DNA, 17 bp, Homo sapiens
cgtccaaggaatggtac

SEQ ID NO: 4036 - DNA, 121 bp, Homo sapiens
ctgcatactttaattatgatgtaatacaggttctgggttgacaaatatcaagacggaggagatctctgaagtgaagatggatgcagaattccgacatgactcaggatatgaagttcatcat

SEQ ID NO: 4037 - DNA, 121 bp, Homo sapiens
atgatgaacttcatatcctgagtcatgtcggaattctgcatccatcttcacttcagagatctcctccgtcttgatatttgtcaacccagaacctgtattacatcataattaaagtatgcag

SEQ ID NO: 4038 - DNA, 17 bp, Homo sapiens
acggaggagatctctga

SEQ ID NO: 4039 - DNA, 17 bp, Homo sapiens
tcagagatctcctccgt

SEQ ID NO: 4040 - DNA, 121 bp, Homo sapiens
attatattgcatttagaaattaaaattctttttcttaatttgttttcaaggtgttctttgcagaagatgtgggttcaaacaaaggtgcaatcattggactcatggtgggcggtgttgtcat

SEQ ID NO: 4041 - DNA, 121 bp, Homo sapiens
atgacaacaccgcccaccatgagtccaatgattgcacctttgtttgaacccacatcttctgcaaagaacaccttgaaaacaaattaagaaaaagaattttaatttctaaatgcaatataat

SEQ ID NO: 4042 - DNA, 17 bp, Homo sapiens
gttctttgcagaagatg

SEQ ID NO: 4043 - DNA, 17 bp, Homo sapiens
catcttctgcaaagaac

SEQ ID NO: 4044 - DNA, 121 bp, Homo sapiens
tatattgcatttagaaattaaaattctttttcttaatttgttttcaaggtgttctttgcagaagatgtgggttcaaacaaaggtgcaatcattggactcatggtgggcggtgttgtcatag

SEQ ID NO: 4045 - DNA, 121 bp, Homo sapiens
ctatgacaacaccgcccaccatgagtccaatgattgcacctttgtttgaacccacatcttctgcaaagaacaccttgaaaacaaattaagaaaaagaattttaatttctaaatgcaatata

SEQ ID NO: 4046 - DNA, 17 bp, Homo sapiens
tctttgcagaagatgtg

SEQ ID NO: 4047 - DNA, 17 bp, Homo sapiens
cacatcttctgcaaaga

SEQ ID NO: 4048 - DNA, 121 bp, Homo sapiens
atattgcatttagaaattaaaattctttttcttaatttgttttcaaggtgttctttgcagaagatgtgggttcaaacaaaggtgcaatcattggactcatggtgggcggtgttgtcatagc

SEQ ID NO: 4049 - DNA, 121 bp, Homo sapiens
gctatgacaacaccgcccaccatgagtccaatgattgcacctttgtttgaacccacatcttctgcaaagaacaccttgaaaacaaattaagaaaaagaattttaatttctaaatgcaatat

SEQ ID NO: 4050 - DNA, 17 bp, Homo sapiens
ctttgcagaagatgtgg

SEQ ID NO: 4051 - DNA, 17 bp, Homo sapiens
ccacatcttctgcaaag

SEQ ID NO: 4052 - DNA, 121 bp, Homo sapiens
gaagatgtgggttcaaacaaaggtgcaatcattggactcatggtgggcggtgttgtcatagcgacagtgatcgtcatcaccttggtgatgctgaagaagaaacagtacacatccattcatc

SEQ ID NO: 4053 - DNA, 121 bp, Homo sapiens
gatgaatggatgtgtactgtttcttcttcagcatcaccaaggtgatgacgatcactgtcgctatgacaacaccgcccaccatgagtccaatgattgcacctttgtttgaacccacatcttc

SEQ ID NO: 4054 - DNA, 17 bp, Homo sapiens
ttgtcatagcgacagtg

SEQ ID NO: 4055 - DNA, 17 bp, Homo sapiens
cactgtcgctatgacaa

SEQ ID NO: 4056 - DNA, 121 bp, Homo sapiens
aagatgtgggttcaaacaaaggtgcaatcattggactcatggtgggcggtgttgtcatagcgacagtgatcgtcatcaccttggtgatgctgaagaagaaacagtacacatccattcatca

SEQ ID NO: 4057 - DNA, 121 bp, Homo sapiens
tgatgaatggatgtgtactgtttcttcttcagcatcaccaaggtgatgacgatcactgtcgctatgacaacaccgcccaccatgagtccaatgattgcacctttgtttgaacccacatctt

SEQ ID NO: 4058 - DNA, 17 bp, Homo sapiens
tgtcatagcgacagtga

SEQ ID NO: 4059 - DNA, 17 bp, Homo sapiens
tcactgtcgctatgaca

SEQ ID NO: 4060 - DNA, 121 bp, Homo sapiens
gtgggttcaaacaaaggtgcaatcattggactcatggtgggcggtgttgtcatagcgacagtgatcgtcatcaccttggtgatgctgaagaagaaacagtacacatccattcatcatggtg

SEQ ID NO: 4061 - DNA, 121 bp, Homo sapiens
caccatgatgaatggatgtgtactgtttcttcttcagcatcaccaaggtgatgacgatcactgtcgctatgacaacaccgcccaccatgagtccaatgattgcacctttgtttgaacccac

SEQ ID NO: 4062 - DNA, 17 bp, Homo sapiens
tagcgacagtgatcgtc

SEQ ID NO: 4063 - DNA, 17 bp, Homo sapiens
gacgatcactgtcgcta

SEQ ID NO: 4064 - DNA, 121 bp, Homo sapiens
ggttcaaacaaaggtgcaatcattggactcatggtgggcggtgttgtcatagcgacagtgatcgtcatcaccttggtgatgctgaagaagaaacagtacacatccattcatcatggtgtgg

SEQ ID NO: 4065 - DNA, 121 bp, Homo sapiens
ccacaccatgatgaatggatgtgtactgtttcttcttcagcatcaccaaggtgatgacgatcactgtcgctatgacaacaccgcccaccatgagtccaatgattgcacctttgtttgaacc

SEQ ID NO: 4066 - DNA, 17 bp, Homo sapiens
cgacagtgatcgtcatc

SEQ ID NO: 4067 - DNA, 17 bp, Homo sapiens
gatgacgatcactgtcg

SEQ ID NO: 4068 - DNA, 121 bp, Homo sapiens
caaacaaaggtgcaatcattggactcatggtgggcggtgttgtcatagcgacagtgatcgtcatcaccttggtgatgctgaagaagaaacagtacacatccattcatcatggtgtggtgga

SEQ ID NO: 4069 - DNA, 121 bp, Homo sapiens
tccaccacaccatgatgaatggatgtgtactgtttcttcttcagcatcaccaaggtgatgacgatcactgtcgctatgacaacaccgcccaccatgagtccaatgattgcacctttgtttg

SEQ ID NO: 4070 - DNA, 17 bp, Homo sapiens
agtgatcgtcatcacct

SEQ ID NO: 4071 - DNA, 17 bp, Homo sapiens
aggtgatgacgatcact

SEQ ID NO: 4072 - DNA, 121 bp, Homo sapiens
tcaaacaaaggtgcaatcattggactcatggtgggcggtgttgtcatagcgacagtgatcgtcatcaccttggtgatgctgaagaagaaacagtacacatccattcatcatggtgtggtgg

SEQ ID NO: 4073 - DNA, 121 bp, Homo sapiens
ccaccacaccatgatgaatggatgtgtactgtttcttcttcagcatcaccaaggtgatgacgatcactgtcgctatgacaacaccgcccaccatgagtccaatgattgcacctttgtttga

SEQ ID NO: 4074 - DNA, 17 bp, Homo sapiens
cagtgatcgtcatcacc

SEQ ID NO: 4075 - DNA, 17 bp, Homo sapiens
ggtgatgacgatcactg

SEQ ID NO: 4076 - DNA, 121 bp, Homo sapiens; identical to SEQ ID NO: 4072

SEQ ID NO: 4077 - DNA, 121 bp, Homo sapiens; identical to SEQ ID NO: 4073

SEQ ID NO: 4078 - DNA, 17 bp, Homo sapiens
cagtgatcgtcatcacc

SEQ ID NO: 4079 - DNA, 17 bp, Homo sapiens
ggtgatgacgatcactg

SEQ ID NO: 4080 - DNA, 121 bp, Homo sapiens
ttggactcatggtgggcggtgttgtcatagcgacagtgatcgtcatcaccttggtgatgctgaagaagaaacagtacacatccattcatcatggtgtggtggaggtaggtaaacttgactg

SEQ ID NO: 4081 - DNA, 121 bp, Homo sapiens
cagtcaagtttacctacctccaccacaccatgatgaatggatgtgtactgtttcttcttcagcatcaccaaggtgatgacgatcactgtcgctatgacaacaccgcccaccatgagtccaa

SEQ ID NO: 4082 - DNA, 17 bp, Homo sapiens
ggtgatgctgaagaaga

SEQ ID NO: 4083 - DNA, 17 bp, Homo sapiens
tcttcttcagcatcacc

SEQ ID NO: 4084 - DNA, 121 bp, Homo sapiens
cccggcaggtggtggagcaagatgaggaagaagatgaggagctgacattgaaatatggcgccaagcatgtgatcatgctctttgtccctgtgactctctgcatggtggtggtcgtggctac

SEQ ID NO: 4085 - DNA, 121 bp, Homo sapiens
gtagccacgaccaccaccatgcagagagtcacagggacaaagagcatgatcacatgcttggcgccatatttcaatgtcagctcctcatcttcttcctcatcttgctccaccacctgccggg

SEQ ID NO: 4086 - DNA, 17 bp, Homo sapiens
atatggcgccaagcatg

SEQ ID NO: 4087 - DNA, 17 bp, Homo sapiens
catgcttggcgccatat

SEQ ID NO: 4088 - DNA, 121 bp, Homo sapiens
gtggtggagcaagatgaggaagaagatgaggagctgacattgaaatatggcgccaagcatgtgatcatgctctttgtccctgtgactctctgcatggtggtggtcgtggctaccattaagt

SEQ ID NO: 4089 - DNA, 121 bp, Homo sapiens
acttaatggtagccacgaccaccaccatgcagagagtcacagggacaaagagcatgatcacatgcttggcgccatatttcaatgtcagctcctcatcttcttcctcatcttgctccaccac

SEQ ID NO: 4090 - DNA, 17 bp, Homo sapiens
ccaagcatgtgatcatg

SEQ ID NO: 4091 - DNA, 17 bp, Homo sapiens
catgatcacatgcttgg

SEQ ID NO: 4092 - DNA, 121 bp, Homo sapiens
aaatatggcgccaagcatgtgatcatgctctttgtccctgtgactctctgcatggtggtggtcgtggctaccattaagtcagtcagcttttatacccggaaggatgggcagctgtacgtat

SEQ ID NO: 4093 - DNA, 121 bp, Homo sapiens
atacgtacagctgcccatccttccgggtataaaagctgactgacttaatggtagccacgaccaccaccatgcagagagtcacagggacaaagagcatgatcacatgcttggcgccatattt

SEQ ID NO: 4094 - DNA, 17 bp, Homo sapiens
tggtggtggtcgtggct

SEQ ID NO: 4095 - DNA, 17 bp, Homo sapiens
agccacgaccaccacca

SEQ ID NO: 4096 - DNA, 121 bp, Homo sapiens
ctttgtccctgtgactctctgcatggtggtggtcgtggctaccattaagtcagtcagcttttatacccggaaggatgggcagctgtacgtatgagttttgttttattattctcaaagccag

SEQ ID NO: 4097 - DNA, 121 bp, Homo sapiens
ctggctttgagaataataaaacaaaactcatacgtacagctgcccatccttccgggtataaaagctgactgacttaatggtagccacgaccaccaccatgcagagagtcacagggacaaag

SEQ ID NO: 4098 - DNA, 17 bp, Homo sapiens
gtcagcttttatacccg

SEQ ID NO: 4099 - DNA, 17 bp, Homo sapiens
cgggtataaaagctgac

SEQ ID NO: 4100 - DNA, 121 bp, Homo sapiens
tggtgatctccattaacactgacctagggcttttgtgtttgttttattgtagaatctataccccattcacagaagataccgagactgtgggccagagagccctgcactcaattctgaatgc

SEQ ID NO: 4101 - DNA, 121 bp, Homo sapiens
gcattcagaattgagtgcagggctctctggcccacagtctcggtatcttctgtgaatggggtatagattctacaataaaacaaacacaaaagccctaggtcagtgttaatggagatcacca

SEQ ID NO: 4102 - DNA, 17 bp, Homo sapiens
aatctataccccattca

SEQ ID NO: 4103 - DNA, 17 bp, Homo sapiens
tgaatggggtatagatt

SEQ ID NO: 4104 - DNA, 121 bp, Homo sapiens
tgatctccattaacactgacctagggcttttgtgtttgttttattgtagaatctataccccattcacagaagataccgagactgtgggccagagagccctgcactcaattctgaatgctgc

SEQ ID NO: 4105 - DNA, 121 bp, Homo sapiens
gcagcattcagaattgagtgcagggctctctggcccacagtctcggtatcttctgtgaatggggtatagattctacaataaaacaaacacaaaagccctaggtcagtgttaatggagatca

SEQ ID NO: 4106 - DNA, 17 bp, Homo sapiens
ctataccccattcacag

SEQ ID NO: 4107 - DNA, 17 bp, Homo sapiens
ctgtgaatggggtatag

SEQ ID NO: 4108 - DNA, 121 bp, Homo sapiens
taacactgacctagggcttttgtgtttgttttattgtagaatctataccccattcacagaagataccgagactgtgggccagagagccctgcactcaattctgaatgctgccatcatgatc

SEQ ID NO: 4109 - DNA, 121 bp, Homo sapiens
gatcatgatggcagcattcagaattgagtgcagggctctctggcccacagtctcggtatcttctgtgaatggggtatagattctacaataaaacaaacacaaaagccctaggtcagtgtta

SEQ ID NO: 4110 - DNA, 17 bp, Homo sapiens
ttcacagaagataccga

SEQ ID NO: 4111 - DNA, 17 bp, Homo sapiens
tcggtatcttctgtgaa

SEQ ID NO: 4112 - DNA, 121 bp, Homo sapiens; identical to SEQ ID NO: 4108

SEQ ID NO: 4113 - DNA, 121 bp, Homo sapiens; identical to SEQ ID NO: 4109

SEQ ID NO: 4114 - DNA, 17 bp, Homo sapiens
ttcacagaagataccga

SEQ ID NO: 4115 - DNA, 17 bp, Homo sapiens
tcggtatcttctgtgaa

SEQ ID NO: 4116 - DNA, 121 bp, Homo sapiens
attaacactgacctagggcttttgtgtttgttttattgtagaatctataccccattcacagaagataccgagactgtgggccagagagccctgcactcaattctgaatgctgccatcatga

SEQ ID NO: 4117 - DNA, 121 bp, Homo sapiens
tcatgatggcagcattcagaattgagtgcagggctctctggcccacagtctcggtatcttctgtgaatggggtatagattctacaataaaacaaacacaaaagccctaggtcagtgttaat

SEQ ID NO: 4118 - DNA, 17 bp, Homo sapiens
cattcacagaagatacc

SEQ ID NO: 4119 - DNA, 17 bp, Homo sapiens
ggtatcttctgtgaatg

SEQ ID NO: 4120 - DNA, 121 bp, Homo sapiens
gacctagggcttttgtgtttgttttattgtagaatctataccccattcacagaagataccgagactgtgggccagagagccctgcactcaattctgaatgctgccatcatgatcagtgtca

SEQ ID NO: 4121 - DNA, 121 bp, Homo sapiens
tgacactgatcatgatggcagcattcagaattgagtgcagggctctctggcccacagtctcggtatcttctgtgaatggggtatagattctacaataaaacaaacacaaaagccctaggtc

SEQ ID NO: 4122 - DNA, 17 bp, Homo sapiens
aagataccgagactgtg

SEQ ID NO: 4123 - DNA, 17 bp, Homo sapiens
cacagtctcggtatctt

SEQ ID NO: 4124 - DNA, 121 bp, Homo sapiens
tataccccattcacagaagataccgagactgtgggccagagagccctgcactcaattctgaatgctgccatcatgatcagtgtcattgttgtcatgactatcctcctggtggttctgtata

SEQ ID NO: 4125 - DNA, 121 bp, Homo sapiens
tatacagaaccaccaggaggatagtcatgacaacaatgacactgatcatgatggcagcattcagaattgagtgcagggctctctggcccacagtctcggtatcttctgtgaatggggtata

SEQ ID NO: 4126 - DNA, 17 bp, Homo sapiens
caattctgaatgctgcc

SEQ ID NO: 4127 - DNA, 17 bp, Homo sapiens
ggcagcattcagaattg

SEQ ID NO: 4128 - DNA, 121 bp, Homo sapiens
agaagataccgagactgtgggccagagagccctgcactcaattctgaatgctgccatcatgatcagtgtcattgttgtcatgactatcctcctggtggttctgtataaatacaggtgctat

SEQ ID NO: 4129 - DNA, 121 bp, Homo sapiens
atagcacctgtatttatacagaaccaccaggaggatagtcatgacaacaatgacactgatcatgatggcagcattcagaattgagtgcagggctctctggcccacagtctcggtatcttct

SEQ ID NO: 4130 - DNA, 17 bp, Homo sapiens
gccatcatgatcagtgt

SEQ ID NO: 4131 - DNA, 17 bp, Homo sapiens
acactgatcatgatggc

SEQ ID NO: 4132 - DNA, 121 bp, Homo sapiens
cagaagataccgagactgtgggccagagagccctgcactcaattctgaatgctgccatcatgatcagtgtcattgttgtcatgactatcctcctggtggttctgtataaatacaggtgcta

SEQ ID NO: 4133 - DNA, 121 bp, Homo sapiens
tagcacctgtatttatacagaaccaccaggaggatagtcatgacaacaatgacactgatcatgatggcagcattcagaattgagtgcagggctctctggcccacagtctcggtatcttctg

SEQ ID NO: 4134 - DNA, 17 bp, Homo sapiens
tgccatcatgatcagtg

SEQ ID NO: 4135 - DNA, 17 bp, Homo sapiens
cactgatcatgatggca

SEQ ID NO: 4136 - DNA, 121 bp, Homo sapiens; identical to SEQ ID NO: 4132

SEQ ID NO: 4137 - DNA, 121 bp, Homo sapiens; identical to SEQ ID NO: 4133

SEQ ID NO: 4138 - DNA, 17 bp, Homo sapiens
tgccatcatgatcagtg

SEQ ID NO: 4139 - DNA, 17 bp, Homo sapiens
cactgatcatgatggca

SEQ ID NO: 4140 - DNA, 121 bp, Homo sapiens
acagaagataccgagactgtgggccagagagccctgcactcaattctgaatgctgccatcatgatcagtgtcattgttgtcatgactatcctcctggtggttctgtataaatacaggtgct

SEQ ID NO: 4141 - DNA, 121 bp, Homo sapiens
agcacctgtatttatacagaaccaccaggaggatagtcatgacaacaatgacactgatcatgatggcagcattcagaattgagtgcagggctctctggcccacagtctcggtatcttctgt

SEQ ID NO: 4142 - DNA, 17 bp, Homo sapiens
ctgccatcatgatcagt

SEQ ID NO: 4143 - DNA, 17 bp, Homo sapiens
actgatcatgatggcag

SEQ ID NO: 4144 - DNA, 121 bp, Homo sapiens
gagactgtgggccagagagccctgcactcaattctgaatgctgccatcatgatcagtgtcattgttgtcatgactatcctcctggtggttctgtataaatacaggtgctataaggtgagca

SEQ ID NO: 4145 - DNA, 121 bp, Homo sapiens
tgctcaccttatagcacctgtatttatacagaaccaccaggaggatagtcatgacaacaatgacactgatcatgatggcagcattcagaattgagtgcagggctctctggcccacagtctc

SEQ ID NO: 4146 - DNA, 17 bp, Homo sapiens
tcagtgtcattgttgtc

SEQ ID NO: 4147 - DNA, 17 bp, Homo sapiens
gacaacaatgacactga

SEQ ID NO: 4148 - DNA, 121 bp, Homo sapiens
agactgtgggccagagagccctgcactcaattctgaatgctgccatcatgatcagtgtcattgttgtcatgactatcctcctggtggttctgtataaatacaggtgctataaggtgagcat

SEQ ID NO: 4149 - DNA, 121 bp, Homo sapiens
atgctcaccttatagcacctgtatttatacagaaccaccaggaggatagtcatgacaacaatgacactgatcatgatggcagcattcagaattgagtgcagggctctctggcccacagtct

SEQ ID NO: 4150 - DNA, 17 bp, Homo sapiens
cagtgtcattgttgtca

SEQ ID NO: 4151 - DNA, 17 bp, Homo sapiens
tgacaacaatgacactg

SEQ ID NO: 4152 - DNA, 121 bp, Homo sapiens
ccagagagccctgcactcaattctgaatgctgccatcatgatcagtgtcattgttgtcatgactatcctcctggtggttctgtataaatacaggtgctataaggtgagcatgagacacaga

SEQ ID NO: 4153 - DNA, 121 bp, Homo sapiens
tctgtgtctcatgctcaccttatagcacctgtatttatacagaaccaccaggaggatagtcatgacaacaatgacactgatcatgatggcagcattcagaattgagtgcagggctctctgg

SEQ ID NO: 4154 - DNA, 17 bp, Homo sapiens
gttgtcatgactatcct

SEQ ID NO: 4155 - DNA, 17 bp, Homo sapiens
aggatagtcatgacaac

SEQ ID NO: 4156 - DNA, 121 bp, Homo sapiens; identical to SEQ ID NO: 4152

SEQ ID NO: 4157 - DNA, 121 bp, Homo sapiens; identical to SEQ ID NO: 4153

SEQ ID NO: 4158 - DNA, 17 bp, Homo sapiens
gttgtcatgactatcct

SEQ ID NO: 4159 - DNA, 17 bp, Homo sapiens
aggatagtcatgacaac

SEQ ID NO: 4160 - DNA, 121 bp, Homo sapiens
ggccagagagccctgcactcaattctgaatgctgccatcatgatcagtgtcattgttgtcatgactatcctcctggtggttctgtataaatacaggtgctataaggtgagcatgagacaca

SEQ ID NO: 4161 - DNA, 121 bp, Homo sapiens
tgtgtctcatgctcaccttatagcacctgtatttatacagaaccaccaggaggatagtcatgacaacaatgacactgatcatgatggcagcattcagaattgagtgcagggctctctggcc

SEQ ID NO: 4162 - DNA, 17 bp, Homo sapiens
ttgttgtcatgactatc

SEQ ID NO: 4163 - DNA, 17 bp, Homo sapiens
gatagtcatgacaacaa

SEQ ID NO: 4164 - DNA, 121 bp, Homo sapiens; identical to SEQ ID NO: 4160

SEQ ID NO: 4165 - DNA, 121 bp, Homo sapiens; identical to SEQ ID NO: 4161

SEQ ID NO: 4166 - DNA, 17 bp, Homo sapiens
ttgttgtcatgactatc

SEQ ID NO: 4167 - DNA, 17 bp, Homo sapiens
gatagtcatgacaacaa

SEQ ID NO: 4168 - DNA, 121 bp, Homo sapiens
agagagccctgcactcaattctgaatgctgccatcatgatcagtgtcattgttgtcatgactatcctcctggtggttctgtataaatacaggtgctataaggtgagcatgagacacagatc

SEQ ID NO: 4169 - DNA, 121 bp, Homo sapiens
gatctgtgtctcatgctcaccttatagcacctgtatttatacagaaccaccaggaggatagtcatgacaacaatgacactgatcatgatggcagcattcagaattgagtgcagggctctct

SEQ ID NO: 4170 - DNA, 17 bp, Homo sapiens
tgtcatgactatcctcc

SEQ ID NO: 4171 - DNA, 17 bp, Homo sapiens
ggaggatagtcatgaca

SEQ ID NO: 4172 - DNA, 121 bp, Homo sapiens
ctttttaagggttgtgggacctgttaattatattgaaatgctttcttttctaggtcatccatgcctggcttattatatcatctctattgttgctgttctttttttcattcatttacttggg

SEQ ID NO: 4173 - DNA, 121 bp, Homo sapiens
cccaagtaaatgaatgaaaaaaagaacagcaacaatagagatgatataataagccaggcatggatgacctagaaaagaaagcatttcaatataattaacaggtcccacaacccttaaaaag

SEQ ID NO: 4174 - DNA, 17 bp, Homo sapiens
ggtcatccatgcctggc

SEQ ID NO: 4175 - DNA, 17 bp, Homo sapiens
gccaggcatggatgacc

SEQ ID NO: 4176 - DNA, 121 bp, Homo sapiens
actttttaagggttgtgggacctgttaattatattgaaatgctttcttttctaggtcatccatgcctggcttattatatcatctctattgttgctgttctttttttcattcatttacttgg

SEQ ID NO: 4177 - DNA, 121 bp, Homo sapiens
ccaagtaaatgaatgaaaaaaagaacagcaacaatagagatgatataataagccaggcatggatgacctagaaaagaaagcatttcaatataattaacaggtcccacaacccttaaaaagt

SEQ ID NO: 4178 - DNA, 17 bp, Homo sapiens
aggtcatccatgcctgg

SEQ ID NO: 4179 - DNA, 17 bp, Homo sapiens
ccaggcatggatgacct

SEQ ID NO: 4180 - DNA, 121 bp, Homo sapiens
agggttgtgggacctgttaattatattgaaatgctttcttttctaggtcatccatgcctggcttattatatcatctctattgttgctgttctttttttcattcatttacttggggtaagtt

SEQ ID NO: 4181 - DNA, 121 bp, Homo sapiens
aacttaccccaagtaaatgaatgaaaaaaagaacagcaacaatagagatgatataataagccaggcatggatgacctagaaaagaaagcatttcaatataattaacaggtcccacaaccct

SEQ ID NO: 4182 - DNA, 17 bp, Homo sapiens
catgcctggcttattat

SEQ ID NO: 4183 - DNA, 17 bp, Homo sapiens
ataataagccaggcatg

SEQ ID NO: 4184 - DNA, 121 bp, Homo sapiens
acctgttaattatattgaaatgctttcttttctaggtcatccatgcctggcttattatatcatctctattgttgctgttctttttttcattcatttacttggggtaagttgtgaaattttt

SEQ ID NO: 4185 - DNA, 121 bp, Homo sapiens
aaaaatttcacaacttaccccaagtaaatgaatgaaaaaaagaacagcaacaatagagatgatataataagccaggcatggatgacctagaaaagaaagcatttcaatataattaacaggt

SEQ ID NO: 4186 - DNA, 17 bp, Homo sapiens
tattatatcatctctat

SEQ ID NO: 4187 - DNA, 17 bp, Homo sapiens
atagagatgatataata

SEQ ID NO: 4188 - DNA, 121 bp, Homo sapiens
taattatattgaaatgctttcttttctaggtcatccatgcctggcttattatatcatctctattgttgctgttctttttttcattcatttacttggggtaagttgtgaaatttttggtctg

SEQ ID NO: 4189 - DNA, 121 bp, Homo sapiens
cagaccaaaaatttcacaacttaccccaagtaaatgaatgaaaaaaagaacagcaacaatagagatgatataataagccaggcatggatgacctagaaaagaaagcatttcaatataatta

SEQ ID NO: 4190 - DNA, 17 bp, Homo sapiens
atcatctctattgttgc

SEQ ID NO: 4191 - DNA, 17 bp, Homo sapiens
gcaacaatagagatgat

SEQ ID NO: 4192 - DNA, 121 bp, Homo sapiens
tattgaaatgctttcttttctaggtcatccatgcctggcttattatatcatctctattgttgctgttctttttttcattcatttacttggggtaagttgtgaaatttttggtctgtctttc

SEQ ID NO: 4193 - DNA, 121 bp, Homo sapiens
gaaagacagaccaaaaatttcacaacttaccccaagtaaatgaatgaaaaaaagaacagcaacaatagagatgatataataagccaggcatggatgacctagaaaagaaagcatttcaata

SEQ ID NO: 4194 - DNA, 17 bp, Homo sapiens
tctattgttgctgttct

SEQ ID NO: 4195 - DNA, 17 bp, Homo sapiens
agaacagcaacaataga

SEQ ID NO: 4196 - DNA, 121 bp, Homo sapiens
tataacgttgctgtggactacattactgttgcactcctgatctggaattttggtgtggtgggaatgatttccattcactggaaaggtccacttcgactccagcaggcatatctcattatga

SEQ ID NO: 4197 - DNA, 121 bp, Homo sapiens
tcataatgagatatgcctgctggagtcgaagtggacctttccagtgaatggaaatcattcccaccacaccaaaattccagatcaggagtgcaacagtaatgtagtccacagcaacgttata

SEQ ID NO: 4198 - DNA, 17 bp, Homo sapiens
gtgtggtgggaatgatt

SEQ ID NO: 4199 - DNA, 17 bp, Homo sapiens
aatcattcccaccacac

SEQ ID NO: 4200 - DNA, 121 bp, Homo sapiens
ataacgttgctgtggactacattactgttgcactcctgatctggaattttggtgtggtgggaatgatttccattcactggaaaggtccacttcgactccagcaggcatatctcattatgat

SEQ ID NO: 4201 - DNA, 121 bp, Homo sapiens
atcataatgagatatgcctgctggagtcgaagtggacctttccagtgaatggaaatcattcccaccacaccaaaattccagatcaggagtgcaacagtaatgtagtccacagcaacgttat

SEQ ID NO: 4202 - DNA, 17 bp, Homo sapiens
tgtggtgggaatgattt

SEQ ID NO: 4203 - DNA, 17 bp, Homo sapiens
aaatcattcccaccaca

SEQ ID NO: 4204 - DNA, 121 bp, Homo sapiens
tggactacattactgttgcactcctgatctggaattttggtgtggtgggaatgatttccattcactggaaaggtccacttcgactccagcaggcatatctcattatgattagtgccctcat

SEQ ID NO: 4205 - DNA, 121 bp, Homo sapiens
atgagggcactaatcataatgagatatgcctgctggagtcgaagtggacctttccagtgaatggaaatcattcccaccacaccaaaattccagatcaggagtgcaacagtaatgtagtcca

SEQ ID NO: 4206 - DNA, 17 bp, Homo sapiens
gatttccattcactgga

SEQ ID NO: 4207 - DNA, 17 bp, Homo sapiens
tccagtgaatggaaatc

SEQ ID NO: 4208 - DNA, 121 bp, Homo sapiens
cactcctgatctggaattttggtgtggtgggaatgatttccattcactggaaaggtccacttcgactccagcaggcatatctcattatgattagtgccctcatggccctggtgtttatcaa

SEQ ID NO: 4209 - DNA, 121 bp, Homo sapiens
ttgataaacaccagggccatgagggcactaatcataatgagatatgcctgctggagtcgaagtggacctttccagtgaatggaaatcattcccaccacaccaaaattccagatcaggagtg

SEQ ID NO: 4210 - DNA, 17 bp, Homo sapiens
aggtccacttcgactcc

SEQ ID NO: 4211 - DNA, 17 bp, Homo sapiens
ggagtcgaagtggacct

SEQ ID NO: 4212 - DNA, 121 bp, Homo sapiens
atttccattcactggaaaggtccacttcgactccagcaggcatatctcattatgattagtgccctcatggccctggtgtttatcaagtacctccctgaatggactgcgtggctcatcttgg

SEQ ID NO: 4213 - DNA, 121 bp, Homo sapiens
ccaagatgagccacgcagtccattcagggaggtacttgataaacaccagggccatgagggcactaatcataatgagatatgcctgctggagtcgaagtggacctttccagtgaatggaaat

SEQ ID NO: 4214 - DNA, 17 bp, Homo sapiens
tgattagtgccctcatg

SEQ ID NO: 4215 - DNA, 17 bp, Homo sapiens
catgagggcactaatca

SEQ ID NO: 4216 - DNA, 121 bp, Homo sapiens
tttccattcactggaaaggtccacttcgactccagcaggcatatctcattatgattagtgccctcatggccctggtgtttatcaagtacctccctgaatggactgcgtggctcatcttggc

SEQ ID NO: 4217 - DNA, 121 bp, Homo sapiens
gccaagatgagccacgcagtccattcagggaggtacttgataaacaccagggccatgagggcactaatcataatgagatatgcctgctggagtcgaagtggacctttccagtgaatggaaa

SEQ ID NO: 4218 - DNA, 17 bp, Homo sapiens
gattagtgccctcatgg

SEQ ID NO: 4219 - DNA, 17 bp, Homo sapiens
ccatgagggcactaatc

SEQ ID NO: 4220 - DNA, 121 bp, Homo sapiens
ttcactggaaaggtccacttcgactccagcaggcatatctcattatgattagtgccctcatggccctggtgtttatcaagtacctccctgaatggactgcgtggctcatcttggctgtgat

SEQ ID NO: 4221 - DNA, 121 bp, Homo sapiens
atcacagccaagatgagccacgcagtccattcagggaggtacttgataaacaccagggccatgagggcactaatcataatgagatatgcctgctggagtcgaagtggacctttccagtgaa

SEQ ID NO: 4222 - DNA, 17 bp, Homo sapiens
tgccctcatggccctgg

SEQ ID NO: 4223 - DNA, 17 bp, Homo sapiens
ccagggccatgagggca

SEQ ID NO: 4224 - DNA, 121 bp, Homo sapiens
ggaaaggtccacttcgactccagcaggcatatctcattatgattagtgccctcatggccctggtgtttatcaagtacctccctgaatggactgcgtggctcatcttggctgtgatttcagt

SEQ ID NO: 4225 - DNA, 121 bp, Homo sapiens
actgaaatcacagccaagatgagccacgcagtccattcagggaggtacttgataaacaccagggccatgagggcactaatcataatgagatatgcctgctggagtcgaagtggacctttcc

SEQ ID NO: 4226 - DNA, 17 bp, Homo sapiens
catggccctggtgttta

SEQ ID NO: 4227 - DNA, 17 bp, Homo sapiens
taaacaccagggccatg

SEQ ID NO: 4228 - DNA, 121 bp, Homo sapiens
tcattatgattagtgccctcatggccctggtgtttatcaagtacctccctgaatggactgcgtggctcatcttggctgtgatttcagtatatggtaaaacccaagactgataatttgtttg

SEQ ID NO: 4229 - DNA, 121 bp, Homo sapiens
caaacaaattatcagtcttgggttttaccatatactgaaatcacagccaagatgagccacgcagtccattcagggaggtacttgataaacaccagggccatgagggcactaatcataatga

SEQ ID NO: 4230 - DNA, 17 bp, Homo sapiens
atggactgcgtggctca

SEQ ID NO: 4231 - DNA, 17 bp, Homo sapiens
tgagccacgcagtccat

SEQ ID NO: 4232 - DNA, 121 bp, Homo sapiens
gtgccctcatggccctggtgtttatcaagtacctccctgaatggactgcgtggctcatcttggctgtgatttcagtatatggtaaaacccaagactgataatttgtttgtcacaggaatgc

SEQ ID NO: 4233 - DNA, 121 bp, Homo sapiens
gcattcctgtgacaaacaaattatcagtcttgggttttaccatatactgaaatcacagccaagatgagccacgcagtccattcagggaggtacttgataaacaccagggccatgagggcac

SEQ ID NO: 4234 - DNA, 17 bp, Homo sapiens
gctcatcttggctgtga

SEQ ID NO: 4235 - DNA, 17 bp, Homo sapiens
tcacagccaagatgagc

SEQ ID NO: 4236 - DNA, 121 bp, Homo sapiens
agtttagcccatacattttattagatgtcttttatgtttttctttttctagatttagtggctgttttgtgtccgaaaggtccacttcgtatgctggttgaaacagctcaggagagaaatga

SEQ ID NO: 4237 - DNA, 121 bp, Homo sapiens
tcatttctctcctgagctgtttcaaccagcatacgaagtggacctttcggacacaaaacagccactaaatctagaaaaagaaaaacataaaagacatctaataaaatgtatgggctaaact

SEQ ID NO: 4238 - DNA, 17 bp, Homo sapiens
tttagtggctgttttgt

SEQ ID NO: 4239 - DNA, 17 bp, Homo sapiens
acaaaacagccactaaa

SEQ ID NO: 4240 - DNA, 121 bp, Homo sapiens
cccatacattttattagatgtcttttatgtttttctttttctagatttagtggctgttttgtgtccgaaaggtccacttcgtatgctggttgaaacagctcaggagagaaatgaaacgctt

SEQ ID NO: 4241 - DNA, 121 bp, Homo sapiens
aagcgtttcatttctctcctgagctgtttcaaccagcatacgaagtggacctttcggacacaaaacagccactaaatctagaaaaagaaaaacataaaagacatctaataaaatgtatggg

SEQ ID NO: 4242 - DNA, 17 bp, Homo sapiens
gctgttttgtgtccgaa

SEQ ID NO: 4243 - DNA, 17 bp, Homo sapiens
ttcggacacaaaacagc

SEQ ID NO: 4244 - DNA, 121 bp, Homo sapiens
ccatacattttattagatgtcttttatgtttttctttttctagatttagtggctgttttgtgtccgaaaggtccacttcgtatgctggttgaaacagctcaggagagaaatgaaacgcttt

SEQ ID NO: 4245 - DNA, 121 bp, Homo sapiens
aaagcgtttcatttctctcctgagctgtttcaaccagcatacgaagtggacctttcggacacaaaacagccactaaatctagaaaaagaaaaacataaaagacatctaataaaatgtatgg

SEQ ID NO: 4246 - DNA, 17 bp, Homo sapiens
ctgttttgtgtccgaaa

SEQ ID NO: 4247 - DNA, 17 bp, Homo sapiens
tttcggacacaaaacag

SEQ ID NO: 4248 - DNA, 121 bp, Homo sapiens
acattttattagatgtcttttatgtttttctttttctagatttagtggctgttttgtgtccgaaaggtccacttcgtatgctggttgaaacagctcaggagagaaatgaaacgctttttcc

SEQ ID NO: 4249 - DNA, 121 bp, Homo sapiens
ggaaaaagcgtttcatttctctcctgagctgtttcaaccagcatacgaagtggacctttcggacacaaaacagccactaaatctagaaaaagaaaaacataaaagacatctaataaaatgt

SEQ ID NO: 4250 - DNA, 17 bp, Homo sapiens
tttgtgtccgaaaggtc

SEQ ID NO: 4251 - DNA, 17 bp, Homo sapiens
gacctttcggacacaaa

SEQ ID NO: 4252 - DNA, 121 bp, Homo sapiens
gtcttttatgtttttctttttctagatttagtggctgttttgtgtccgaaaggtccacttcgtatgctggttgaaacagctcaggagagaaatgaaacgctttttccagctctcatttact

SEQ ID NO: 4253 - DNA, 121 bp, Homo sapiens
agtaaatgagagctggaaaaagcgtttcatttctctcctgagctgtttcaaccagcatacgaagtggacctttcggacacaaaacagccactaaatctagaaaaagaaaaacataaaagac

SEQ ID NO: 4254 - DNA, 17 bp, Homo sapiens
gtccacttcgtatgctg

SEQ ID NO: 4255 - DNA, 17 bp, Homo sapiens
cagcatacgaagtggac

SEQ ID NO: 4256 - DNA, 121 bp, Homo sapiens
tcttttatgtttttctttttctagatttagtggctgttttgtgtccgaaaggtccacttcgtatgctggttgaaacagctcaggagagaaatgaaacgctttttccagctctcatttactc

SEQ ID NO: 4257 - DNA, 121 bp, Homo sapiens
gagtaaatgagagctggaaaaagcgtttcatttctctcctgagctgtttcaaccagcatacgaagtggacctttcggacacaaaacagccactaaatctagaaaaagaaaaacataaaaga

SEQ ID NO: 4258 - DNA, 17 bp, Homo sapiens
tccacttcgtatgctgg

SEQ ID NO: 4259 - DNA, 17 bp, Homo sapiens
ccagcatacgaagtgga

SEQ ID NO: 4260 - DNA, 121 bp, Homo sapiens
tagtggctgttttgtgtccgaaaggtccacttcgtatgctggttgaaacagctcaggagagaaatgaaacgctttttccagctctcatttactcctgtaagtatttgagaatgatattgaa

SEQ ID NO: 4261 - DNA, 121 bp, Homo sapiens
ttcaatatcattctcaaatacttacaggagtaaatgagagctggaaaaagcgtttcatttctctcctgagctgtttcaaccagcatacgaagtggacctttcggacacaaaacagccacta

SEQ ID NO: 4262 - DNA, 17 bp, Homo sapiens
tcaggagagaaatgaaa

SEQ ID NO: 4263 - DNA, 17 bp, Homo sapiens
tttcatttctctcctga

SEQ ID NO: 4264 - DNA, 121 bp, Homo sapiens
ctgttttgtgtccgaaaggtccacttcgtatgctggttgaaacagctcaggagagaaatgaaacgctttttccagctctcatttactcctgtaagtatttgagaatgatattgaattagta

SEQ ID NO: 4265 - DNA, 121 bp, Homo sapiens
tactaattcaatatcattctcaaatacttacaggagtaaatgagagctggaaaaagcgtttcatttctctcctgagctgtttcaaccagcatacgaagtggacctttcggacacaaaacag

SEQ ID NO: 4266 - DNA, 17 bp, Homo sapiens
gagaaatgaaacgcttt

SEQ ID NO: 4267 - DNA, 17 bp, Homo sapiens
aaagcgtttcatttctc

SEQ ID NO: 4268 - DNA, 121 bp, Homo sapiens; identical to SEQ ID NO: 4264

SEQ ID NO: 4269 - DNA, 121 bp, Homo sapiens; identical to SEQ ID NO: 4265

SEQ ID NO: 4270 - DNA, 17 bp, Homo sapiens
gagaaatgaaacgcttt

SEQ ID NO: 4271 - DNA, 17 bp, Homo sapiens
aaagcgtttcatttctc

SEQ ID NO: 4272 - DNA, 121 bp, Homo sapiens
tgtgtccgaaaggtccacttcgtatgctggttgaaacagctcaggagagaaatgaaacgctttttccagctctcatttactcctgtaagtatttgagaatgatattgaattagtaatcagt

SEQ ID NO: 4273 - DNA, 121 bp, Homo sapiens
actgattactaattcaatatcattctcaaatacttacaggagtaaatgagagctggaaaaagcgtttcatttctctcctgagctgtttcaaccagcatacgaagtggacctttcggacaca

SEQ ID NO: 4274 - DNA, 17 bp, Homo sapiens
tgaaacgctttttccag

SEQ ID NO: 4275 - DNA, 17 bp, Homo sapiens
ctggaaaaagcgtttca

SEQ ID NO: 4276 - DNA, 121 bp, Homo sapiens
aaggtccacttcgtatgctggttgaaacagctcaggagagaaatgaaacgctttttccagctctcatttactcctgtaagtatttgagaatgatattgaattagtaatcagtgtagaattt

SEQ ID NO: 4277 - DNA, 121 bp, Homo sapiens
aaattctacactgattactaattcaatatcattctcaaatacttacaggagtaaatgagagctggaaaaagcgtttcatttctctcctgagctgtttcaaccagcatacgaagtggacctt

SEQ ID NO: 4278 - DNA, 17 bp, Homo sapiens
ttttccagctctcattt

SEQ ID NO: 4279 - DNA, 17 bp, Homo sapiens
aaatgagagctggaaaa

SEQ ID NO: 4280 - DNA, 121 bp, Homo sapiens
ggtccacttcgtatgctggttgaaacagctcaggagagaaatgaaacgctttttccagctctcatttactcctgtaagtatttgagaatgatattgaattagtaatcagtgtagaatttat

SEQ ID NO: 4281 - DNA, 121 bp, Homo sapiens
ataaattctacactgattactaattcaatatcattctcaaatacttacaggagtaaatgagagctggaaaaagcgtttcatttctctcctgagctgtttcaaccagcatacgaagtggacc

SEQ ID NO: 4282 - DNA, 17 bp, Homo sapiens
ttccagctctcatttac

SEQ ID NO: 4283 - DNA, 17 bp, Homo sapiens
gtaaatgagagctggaa

SEQ ID NO: 4284 - DNA, 121 bp, Homo sapiens
gtgaccaactttttaatatttgtaacctttcctttttagggggagtaaaacttggattgggagatttcattttctacagtgttctggttggtaaagcctcagcaacagccagtggagactg

SEQ ID NO: 4285 - DNA, 121 bp, Homo sapiens
cagtctccactggctgttgctgaggctttaccaaccagaacactgtagaaaatgaaatctcccaatccaagttttactccccctaaaaaggaaaggttacaaatattaaaaagttggtcac

SEQ ID NO: 4286 - DNA, 17 bp, Homo sapiens
tggattgggagatttca

SEQ ID NO: 4287 - DNA, 17 bp, Homo sapiens
tgaaatctcccaatcca

SEQ ID NO: 4288 - DNA, 121 bp, Homo sapiens
tttgtaacctttcctttttagggggagtaaaacttggattgggagatttcattttctacagtgttctggttggtaaagcctcagcaacagccagtggagactggaacacaaccatagcctg

SEQ ID NO: 4289 - DNA, 121 bp, Homo sapiens
caggctatggttgtgttccagtctccactggctgttgctgaggctttaccaaccagaacactgtagaaaatgaaatctcccaatccaagttttactccccctaaaaaggaaaggttacaaa

SEQ ID NO: 4290 - DNA, 17 bp, Homo sapiens
tttctacagtgttctgg

SEQ ID NO: 4291 - DNA, 17 bp, Homo sapiens
ccagaacactgtagaaa

SEQ ID NO: 4292 - DNA, 121 bp, Homo sapiens
aacctttcctttttagggggagtaaaacttggattgggagatttcattttctacagtgttctggttggtaaagcctcagcaacagccagtggagactggaacacaaccatagcctgtttcg

SEQ ID NO: 4293 - DNA, 121 bp, Homo sapiens
cgaaacaggctatggttgtgttccagtctccactggctgttgctgaggctttaccaaccagaacactgtagaaaatgaaatctcccaatccaagttttactccccctaaaaaggaaaggtt

SEQ ID NO: 4294 - DNA, 17 bp, Homo sapiens
acagtgttctggttggt

SEQ ID NO: 4295 - DNA, 17 bp, Homo sapiens
accaaccagaacactgt

SEQ ID NO: 4296 - DNA, 121 bp, Homo sapiens
atttcattttctacagtgttctggttggtaaagcctcagcaacagccagtggagactggaacacaaccatagcctgtttcgtagccatattaattgtaagtatacactaataagaatgtgt

SEQ ID NO: 4297 - DNA, 121 bp, Homo sapiens
acacattcttattagtgtatacttacaattaatatggctacgaaacaggctatggttgtgttccagtctccactggctgttgctgaggctttaccaaccagaacactgtagaaaatgaaat

SEQ ID NO: 4298 - DNA, 17 bp, Homo sapiens
agactggaacacaacca

SEQ ID NO: 4299 - DNA, 17 bp, Homo sapiens
tggttgtgttccagtct

SEQ ID NO: 4300 - DNA, 121 bp, Homo sapiens
tacagtgttctggttggtaaagcctcagcaacagccagtggagactggaacacaaccatagcctgtttcgtagccatattaattgtaagtatacactaataagaatgtgtcagagctctta

SEQ ID NO: 4301 - DNA, 121 bp, Homo sapiens
taagagctctgacacattcttattagtgtatacttacaattaatatggctacgaaacaggctatggttgtgttccagtctccactggctgttgctgaggctttaccaaccagaacactgta

SEQ ID NO: 4302 - DNA, 17 bp, Homo sapiens
caaccatagcctgtttc

SEQ ID NO: 4303 - DNA, 17 bp, Homo sapiens
gaaacaggctatggttg

SEQ ID NO: 4304 - DNA, 121 bp, Homo sapiens
gtgttctggttggtaaagcctcagcaacagccagtggagactggaacacaaccatagcctgtttcgtagccatattaattgtaagtatacactaataagaatgtgtcagagctcttaatgt

SEQ ID NO: 4305 - DNA, 121 bp, Homo sapiens
acattaagagctctgacacattcttattagtgtatacttacaattaatatggctacgaaacaggctatggttgtgttccagtctccactggctgttgctgaggctttaccaaccagaacac

SEQ ID NO: 4306 - DNA, 17 bp, Homo sapiens
catagcctgtttcgtag

SEQ ID NO: 4307 - DNA, 17 bp, Homo sapiens
ctacgaaacaggctatg

SEQ ID NO: 4308 - DNA, 121 bp, Homo sapiens
tgtgaatgtgtgtctttcccatcttctccacagggtttgtgccttacattattactccttgccattttcaagaaagcattgccagctcttccaatctccatcacctttgggcttgttttct

SEQ ID NO: 4309 - DNA, 121 bp, Homo sapiens
agaaaacaagcccaaaggtgatggagattggaagagctggcaatgctttcttgaaaatggcaaggagtaataatgtaaggcacaaaccctgtggagaagatgggaaagacacacattcaca

SEQ ID NO: 4310 - DNA, 17 bp, Homo sapiens
tactccttgccattttc

SEQ ID NO: 4311 - DNA, 17 bp, Homo sapiens
gaaaatggcaaggagta

SEQ ID NO: 4312 - DNA, 121 bp, Homo sapiens
agggtttgtgccttacattattactccttgccattttcaagaaagcattgccagctcttccaatctccatcacctttgggcttgttttctactttgccacagattatcttgtacagccttt

SEQ ID NO: 4313 - DNA, 121 bp, Homo sapiens
aaaggctgtacaagataatctgtggcaaagtagaaaacaagcccaaaggtgatggagattggaagagctggcaatgctttcttgaaaatggcaaggagtaataatgtaaggcacaaaccct

SEQ ID NO: 4314 - DNA, 17 bp, Homo sapiens
agctcttccaatctcca

SEQ ID NO: 4315 - DNA, 17 bp, Homo sapiens
tggagattggaagagct

SEQ ID NO: 4316 - DNA, 121 bp, Homo sapiens
cagggtttgtgccttacattattactccttgccattttcaagaaagcattgccagctcttccaatctccatcacctttgggcttgttttctactttgccacagattatcttgtacagcctt

SEQ ID NO: 4317 - DNA, 121 bp, Homo sapiens
aaggctgtacaagataatctgtggcaaagtagaaaacaagcccaaaggtgatggagattggaagagctggcaatgctttcttgaaaatggcaaggagtaataatgtaaggcacaaaccctg

SEQ ID NO: 4318 - DNA, 17 bp, Homo sapiens
cagctcttccaatctcc

SEQ ID NO: 4319 - DNA, 17 bp, Homo sapiens
ggagattggaagagctg

SEQ ID NO: 4320 - DNA, 121 bp, Homo sapiens
gatgtggtttcccacagagaagccaggagaacgaggaggacggtgaggaggaccctgaccgctatgtctgtagtggggttcccgggcggccgccaggcctggaggaagagctgaccctcaa

SEQ ID NO: 4321 - DNA, 121 bp, Homo sapiens
ttgagggtcagctcttcctccaggcctggcggccgcccgggaaccccactacagacatagcggtcagggtcctcctcaccgtcctcctcgttctcctggcttctctgtgggaaaccacatc

SEQ ID NO: 4322 - DNA, 17 bp, Homo sapiens
ccctgaccgctatgtct

SEQ ID NO: 4323 - DNA, 17 bp, Homo sapiens
agacatagcggtcaggg

SEQ ID NO: 4324 - DNA, 121 bp, Homo sapiens
gcctcgaggagcagtcagggccgggagcatcagccctttgccttctccctcagcatctacacgacattcactgaggacacaccctcggtgggccagcgcctcctcaactccgtgctgaaca

SEQ ID NO: 4325 - DNA, 121 bp, Homo sapiens
tgttcagcacggagttgaggaggcgctggcccaccgagggtgtgtcctcagtgaatgtcgtgtagatgctgagggagaaggcaaagggctgatgctcccggccctgactgctcctcgaggc

SEQ ID NO: 4326 - DNA, 17 bp, Homo sapiens
gcatctacacgacattc

SEQ ID NO: 4327 - DNA, 17 bp, Homo sapiens
gaatgtcgtgtagatgc

SEQ ID NO: 4328 - DNA, 121 bp, Homo sapiens
acacgccattcactgaggacacaccctcggtgggccagcgcctcctcaactccgtgctgaacaccctcatcatgatcagcgtcatcgtggttatgaccatcttcttggtggtgctctacaa

SEQ ID NO: 4329 - DNA, 121 bp, Homo sapiens
ttgtagagcaccaccaagaagatggtcataaccacgatgacgctgatcatgatgagggtgttcagcacggagttgaggaggcgctggcccaccgagggtgtgtcctcagtgaatggcgtgt

SEQ ID NO: 4330 - DNA, 17 bp, Homo sapiens
cgtgctgaacaccctca

SEQ ID NO: 4331 - DNA, 17 bp, Homo sapiens
tgagggtgttcagcacg

SEQ ID NO: 4332 - DNA, 121 bp, Homo sapiens
ccactggaagggccctctggtgctgcagcaggcctacctcatcatgatcagtgcgctcatggccctagtgttcatcaagtacctcccagagtggtccgcgtgggtcatcctgggcgccatc

SEQ ID NO: 4333 - DNA, 121 bp, Homo sapiens
gatggcgcccaggatgacccacgcggaccactctgggaggtacttgatgaacactagggccatgagcgcactgatcatgatgaggtaggcctgctgcagcaccagagggcccttccagtgg

SEQ ID NO: 4334 - DNA, 17 bp, Homo sapiens
gcgctcatggccctagt

SEQ ID NO: 4335 - DNA, 17 bp, Homo sapiens
actagggccatgagcgc

SEQ ID NO: 4336 - DNA, 121 bp, Homo sapiens
atccactggaagggccctctggtgctgcagcaggcctacctcatcatgatcagtgcgctcatggccctagtgttcatcaagtacctcccagagtggtccgcgtgggtcatcctgggcgcca

SEQ ID NO: 4337 - DNA, 121 bp, Homo sapiens
tggcgcccaggatgacccacgcggaccactctgggaggtacttgatgaacactagggccatgagcgcactgatcatgatgaggtaggcctgctgcagcaccagagggcccttccagtggat

SEQ ID NO: 4338 - DNA, 17 bp, Homo sapiens
gtgcgctcatggcccta

SEQ ID NO: 4339 - DNA, 17 bp, Homo sapiens
tagggccatgagcgcac

SEQ ID NO: 4340 - DNA, 121 bp, Homo sapiens
ttgactgaatgcttattttggcctgtgtctctccctctttctcagatataacagtttgtgcccatgaccacatcagctggcatctgctgggaatgagctcggggccagaattattctccat

SEQ ID NO: 4341 - DNA, 70 bp, Artificial Sequence
  stem_loop (1) ... (54)
  stem_loop (55) ... (70): Description of Artificial Sequence: Combined DNA/RNA oligonucleotide
gcuauucggcuaggacugggcacaauuuuttgtgcccagtcgtagccgaatagcctctccuuuuggagag

SEQ ID NO: 4342 - DNA, 68 bp, Artificial Sequence
  stem_loop (1) ... (54)
  stem_loop (55) ... (68): Description of Artificial Sequence: Combined DNA/RNA oligonucleotide
ttcccacagcatcgccagtcactatttttauagugacuggcaatgcugucggaagcgcgttttcgcgc

SEQ ID NO: 4343 - DNA, 15 bp, Escherichia coli
ttcggctaggactgg

SEQ ID NO: 4344 - DNA, 15 bp, Escherichia coli
aagccgatcctgacc

SEQ ID NO: 4345 - DNA, 15 bp, Escherichia coli
ttcggctacgactgg

SEQ ID NO: 4346 - DNA, 15 bp, Escherichia coli
aagccgatgctgacc

SEQ ID NO: 4347 - DNA, 28 bp, Escherichia coli
aggctattcggctaggactgggcacaac

SEQ ID NO: 4348 - DNA, 28 bp, Escherichia coli
aggctattcggctacgactgggcacaac

SEQ ID NO: 4349 - DNA, 13 bp, Escherichia coli
ttcggctatgact

SEQ ID NO: 4350 - DNA, 15 bp, Escherichia coli
gacagcatcgccagt

SEQ ID NO: 4351 - DNA, 14 bp, Escherichia coli
gacagcatgccagt

SEQ ID NO: 4352 - DNA, 15 bp, Escherichia coli
gacagcattgccagt

SEQ ID NO: 4353 - DNA, 15 bp, Escherichia coli
gacagcatgccagtc

SEQ ID NO: 4354 - DNA, 16 bp, Escherichia coli
gacagcattgccagtc

SEQ ID NO: 4355 - DNA, 18 bp, Escherichia coli
tattcggctacgactggg

SEQ ID NO: 4356 - DNA, 18 bp, Escherichia coli
tattcggctcggactggg

SEQ ID NO: 4357 - DNA, 18 bp, Escherichia coli
tattcggctgggactggg

SEQ ID NO: 4358 - DNA, 18 bp, Escherichia coli
tattcggctaggactggg

SEQ ID NO: 4359 - DNA, 13 bp, Escherichia coli
gtggatatgtcct

SEQ ID NO: 4360 - DNA, 14 bp, Escherichia coli
gtggataatgtcct

SEQ ID NO: 4361 - DNA, 13 bp, Escherichia coli
gtggatacgtcct

SEQ ID NO: 4362 - DNA, 13 bp, Escherichia coli
gtggataggtcct

SEQ ID NO: 4363 - DNA, 25 bp, Artificial Sequence
  misc_feature (1) ... (3)
  misc_feature (22) ... (24): Description of Artificial Sequence: Oligonucleotide with phosphorothioate linkages
agggcgtggatacgtcctgcgggta

SEQ ID NO: 4364 - DNA, 74 bp, Artificial Sequence
  misc_feature (1) ... (3)
  misc_feature (71) ... (73): Description of Artificial Sequence: Oligonucleotide with phosphorothioate linkages
ctcgtgctttcagcttcgatgtaggagggcgtggatacgtcctgcgggtaaatagctgcgccgatggtttctac

SEQ ID NO: 4365 - DNA, 74 bp, Artificial Sequence
  misc_feature (1) ... (3)
  misc_feature (72) ... (74): Description of Artificial Sequence: Oligonucleotide with phosphorothioate linkages
gtagaaaccatcggcgcagctatttacccgcaggacgtatccacgccctcctacatcgaagctgaaagcacgag

SEQ ID NO: 4366 - DNA, 70 bp, Artificial Sequence
  stem_loop (1) ... (54)
  stem_loop (55) ... (70): Description of Artificial Sequence: Combined DNA/RNA oligonucleotide
agggcguggataggtccugcggguatttttacccgcaggacgtatccacgccctcctacatttttgtagg

SEQ ID NO: 4367 - DNA, 70 bp, Artificial Sequence
  misc_feature (1) ... (3)
  misc_feature (67) ... (69): Description of Artificial Sequence: Oligonucleotide with phosphorothioate linkages
catcagagcagccaattgtctgttgtgcccagtcgtagccgaatagcctctccacccaagcggccggaga

SEQ ID NO: 4368 - protein, 19 aa, Artificial Sequence
  Description of Artificial Sequence: FlAsH peptide sequence
RVDAAAREACCRECCARAI

SEQ ID NO: 4369 - DNA, 18 bp, Artificial Sequence
  Description of Artificial Sequence: Oligonucleotide
aatacgactcactatagg

SEQ ID NO: 4370 - DNA, 18 bp, Artificial Sequence
  Description of Artificial Sequence: Oligonucleotide
gacctatccacgccctcc

SEQ ID NO: 4371 - DNA, 17 bp, Artificial Sequence
  Description of Artificial Sequence: Oligonucleotide
gactatccacgccctcc

SEQ ID NO: 4372 - DNA, 19 bp, Artificial Sequence
  Description of Artificial Sequence: Oligonucleotide
gacattatccacgccctcc

SEQ ID NO: 4373 - DNA, 18 bp, Artificial Sequence
  Description of Artificial Sequence: Oligonucleotide
ctgggataggtcctgcgg

SEQ ID NO: 4374 - DNA, 17 bp, Artificial Sequence
  Description of Artificial Sequence: Oligonucleotide
cgtggatagtcctgcgg

SEQ ID NO: 4375 - DNA, 19 bp, Artificial Sequence
  Description of Artificial Sequence: Oligonucleotide
cgtggataatgtcctgcgg

SEQ ID NO: 4376 - DNA, 18 bp, Artificial Sequence
  Description of Artificial Sequence: Oligonucleotide
aaatcacgccatgtagtg

SEQ ID NO: 4377 - DNA, 25 bp, Artificial Sequence
  misc_feature (1) ... (3)
  misc_feature (23) ... (25): Description of Artificial Sequence: Oligonucleotide with phosphorothioate linkages
ttcgataagcctatgctgacccgtg

SEQ ID NO: 4378 - DNA, 33 bp, Artificial Sequence
  misc_feature (1) ... (3): Description of Artificial Sequence: Oligonucleotide with phosphorothioate linkages
ttcggctacgactgggcacaacagacaattggc

SEQ ID NO: 4379 - DNA, 25 bp, Artificial Sequence
  Description of Artificial Sequence: Oligonucleotide
ttgtgcccagtcgtatccgaatagc

SEQ ID NO: 4380 - DNA, 70 bp, Artificial Sequence; identical to SEQ ID NO: 4367
  Description of Artificial Sequence: Oligonucleotide

SEQ ID NO: 4381 - DNA, 71 bp, Artificial Sequence
  Description of Artificial Sequence: Oligonucleotide
gctgacagccggaacacggcggcatcagagcagccaattgtctgttgtgcccagtcgtagccgaatagcct

SEQ ID NO: 4382 - DNA, 74 bp, Artificial Sequence
  Description of Artificial Sequence: Oligonucleotide
ctcgtgctttcagcttcgatgtaggagggcgtgggtacgtcctgcgggtaaatagctgcgccgatggtttctac

SEQ ID NO: 4383 - DNA, 74 bp, Artificial Sequence
  Description of Artificial Sequence: Oligonucleotide
ctcgtgctttcagcttcgatgtaggagggcgtggatacgtcctgcgggtaaacagctgcgccgatggtttctac

SEQ ID NO: 4384 - DNA, 74 bp, Artificial Sequence
  Description of Artificial Sequence: Oligonucleotide
ctcgtgctttcagcttcgatgtaggagggcgtggatacgtcctgcgggtaaatagctgcgccgacggtttctac

SEQ ID NO: 4385 - protein, 6 aa, Artificial Sequence
  Description of Artificial Sequence: FlAsH peptide sequence
CCRECC

What is claimed is:

1. A method of optimizing an oligonucleotide for in vitro targeted chromosomal sequence alteration, comprising:
   (a) Providing a first oligonucleotide and a second oligonucleotide for alteration of a targeted nucleic acid sequence,
      i) wherein said first oligonucleotide:
         (1) is a single-stranded nonhairpin oligonucleotide 17-121 nucleotides in length,
         (2) has an unmodified DNA domain of at least 8 contiguous deoxyribonucleotides,
         (3) is fully complementary in sequence to the sequence of a first strand of the nucleic acid target but for one or more mismatches as between the sequences of said deoxyribonucleotides domain and its complement on the target nucleic acid first strand, each of said mismatches positioned at least 8 nucleotides from said first oligonucleotide's 5' and 3' termini, and
         (4) has at least one terminal modification selected from the group consisting of: at least one terminal locked nucleic acid (LNA), at least one terminal 2'-O-Me base analog, and at least three terminal phophorothioate linkages, and
      ii) wherein said second oligonucleotide is selected from the group consisting of
         (1) an oligonucleotide that is fully complementary to the target and lacks the mismatch,
         (2) a fully modified phosphothiolated oligonucleotide,
         (3) a fully modified 2'-O-methylated oligonucleotide, and
         (4) a chimeric double-stranded double hairpin containing RNA and DNA nucleotides, and
      iii) wherein the targeted nucleic acid sequence alteration is not in human embryonic stem cells;
   (b) combining the targeted nucleic acid with said first or said second oligonucleotide in the presence of cellular repair proteins;
   (c) combining the targeted nucleic acid with the other of said first or second oligonucleotide in the presence of cellular repair proteins;
   (d) quantifying the percentage of target molecules that undergo a sequence alteration event;
   (e) comparing the efficiency of alteration of said targeted nucleic acid sequence by said first oligonucleotide with the efficiency of alteration of the same targeted nucleic acid sequence by said second oligonucleotide; and
   (f) repeating steps (a) through (e) two or more times to optimize said first oligonucleotide for in vitro targeted chromosomal sequence alteration.

2. The method of claim 1, wherein said sequence alteration is a substitution of at least one base.

3. The method of claim 1, wherein said sequence alteration is a deletion of at least one base.

4. The method of claim 1, wherein said sequence alteration is an insertion of at least one base.

5. The method of claim 1, wherein the target nucleic acid is cellular chromosomal DNA.

6. The method of claim 1, wherein the target nucleic acid is an artificial chromosome.

7. The method of claim 1, wherein the alteration is produced in a cell.

8. The method of claim 7, wherein said cell is cultured ex vivo.

9. The method of claim 1, wherein the alteration is produced in a cell-free extract.

10. The method of claim 1, wherein said cellular repair proteins are of a cell selected from the group consisting of prokaryotic cells and eukaryotic cells.

11. The method of claim 10, wherein said cell is a prokaryotic cell.

12. The method of claim 11, wherein said prokaryotic cell is a bacterial cell.

13. The method of claim 12, wherein said bacterial cell is an *E. coli* cell.

14. The method of claim 10, wherein said cell is a eukaryotic cell.

15. The method of claim 14, wherein said eukaryotic cell is a yeast cell, plant cell, human cell, or a mammalian cell.

16. The method of claim 15, wherein said eukaryotic cell is a yeast cell.

17. The method of claim 16, wherein said yeast cell is a *Saccharomyces cerevisiae, Ustilago maydis,* or *Candida albicans* cell.

18. The method of claim 15, wherein said eukaryotic cell is a plant cell.

19. The method of claim 15, wherein said eukaryotic cell is a human cell.

20. The method of claim 19, wherein said human cell is selected from the group consisting of liver cell, lung cell, colon cell, cervical cell, kidney cell, epithelial cell, cancer cell, and stem cell.

21. The method of claim 15, wherein said eukaryotic cell is from a mammal.

22. The method of claim 21, wherein said mammal is selected from the group consisting of rodent, mouse, hamster, rat, and monkey.

23. The method of claim 1, wherein said first oligonucleotide is at least 25 nucleotides in length.

24. The method of claim 1, wherein said first oligonucleotide is no more than 74 nucleotides in length.

25. The method of claim 1, wherein said first strand is the nontranscribed strand of the target nucleic acid.

26. The method of claim 1, wherein the sequences of said deoxyribonucleotides domain and of the target nucleic acid first strand are mismatched at a single nucleotide.

27. The method of claim 1, wherein the sequences of said deoxyribonucleotides domain and of its complement on the target nucleic acid first strand are mismatched at two or more nucleotides.

28. The method of claim 1, wherein said at least one terminal modification is at least on 3' terminal LNA analog.

29. The method of claim 1, wherein said first oligonucleotide has no more than 3 LNA analogs at its 3' terminus.

30. The method of claim 1, wherein said first oligonucleotide has at least one LNA at its 3' terminus and at least one LNA at its 5' terminus.

31. The method of claim 30, wherein said first oligonucleotide has no more than 3 contiguous LNA at each of its 3' or 5' termini.

32. The method of claim 1, wherein said at least one terminal modification is at least one 2'-O-methyl ribonucleotides analog at its 3' terminus.

33. The method of claim 32, wherein said first oligonucleotide has no more than 4 contiguous 2'-O-methyl ribonucleotides analogs.

34. The method of claim 32, wherein said first oligonucleotide has at least one 2'-O-methyl ribonucleotide analog at its 3' terminus and at least one 2'-O-methyl ribonucleotide analog at its 5' terminus.

35. The method of claim 34, wherein said first oligonucleotide has no more than 4 contiguous 2'-O-methyl ribonucleotides analogs.

36. The method of claim 1, wherein said at least one terminal modification comprises at least three terminal phosphorothioate linkages.

37. The method of claim 36, wherein said phosphorothioate linkages are at said first oligonucleotide's 3' terminus.

38. The method of claim 36, wherein said first oligonucleotide comprises no more than 6 contiguous phosphorothioate linkages.

39. The method of claim 1, wherein said second oligonucleotide is fully complementary to the target and lacks the mismatch.

40. The method of claim 1, wherein said second oligonucleotide is a fully modified phosphothiolated oligonucleotide.

41. The method of claim 1, wherein said second oligonucleotide is a fully modified 2'-O-methylated oligonucleotide.

42. The method of claim 1, wherein said second oligonucleotide is a chimeric double-stranded double hairpin containing RNA and DNA nucleotides.

43. A method of optimizing an oligonuoleotide for targeted nucleic acid sequence alteration of a nucleic acid present within selectively enriched cells in vitro, cells in culture, or cell-free extracts, comprising:

(a) Providing a first oligonucleotide and a second oligonucleotide for alteration of a targeted nucleic acid sequence,
  i) wherein said first oligonucleotide:
    (1) is a single-stranded nonhairpin oligonucleotide 17-121 nucleotides in length,
    (2) has an unmodified DNA domain of at least 8 contiguous deoxyribonucleotides,
    (3) is fully complementary in sequence to the sequence of a first strand of the nucleic acid target but for one or more mismatches as between the sequences of said deoxyribonucleotides domain and its complement on the target nucleic acid first strand, each of said mismatches positioned at least 8 nucleotides from said first oligonucleotide's 5' and 3' termini, and
    (4) has at least one terminal modification selected from the group consisting of: at least one terminal locked nucleic acid (LNA), at least one terminal 2'-O-Me base analog, and at least three terminal phophorothioate linkages, and
  ii) wherein said second oligonucleotide is selected from the group consisting of
    (1) an oligonucleotide that is fully complementary to the target and lacks the mismatch,
    (2) a fully modified phosphothiolated oligonucleotide,
    (3) a fully modified 2'-O-methylated oligonucleotide, and
    (4) a chimeric double-stranded double hairpin containing RNA and DNA nucleotides, and
  iii) wherein said cultured or selectively enriched cells are not human embryonic stem cells, and
  iv) wherein said targeted nucleic acid is selected from the group of human genes consisting of: ADA, p53, beta-globin, RB, BRCA1, BRCA2, CFTR, CDKN2A, APC, Factor V, Factor VIII, Factor IX, hemoglobin alpha 1, hemoglobin alpha 2, MLH1, MSH2, MSH6, ApoE, LDL receptor, UGT1, APP, PSEN1, and PSEN2;

(b) combining the targeted nucleic acid with said first or said second oligonucleotide in the presence of cellular repair proteins;

(c) combining the targeted nucleic acid with the other of said first or said second oligonucleotide in the presence of cellular repair proteins;

(d) quantifying the percentage of target molecules that undergo a sequence alteration event;

(e) comparing the efficiency of alteration of said targeted nucleic acid sequence by said first oligonucleotide with the efficiency of alteration of the same targeted nucleic acid sequence by said second oligonucleotide; and (f) repeating steps (a) through (e) two or more times to optimize said first oligonucleotide for targeted nucleic acid sequence alteration.

44. A method of optimizing an oligonucleotide for targeted sequence alteration of a nucleic acid present within selectively enriched cells in vitro, cells in culture, or cell-free extracts, comprising:

(a) Providing a first oligonucleotide and a second oligonucleotide for alteration of a targeted nucleic acid sequence,
  i) wherein said first oligonucleotide:
    (1) is a single-stranded nonhairpin oligonucleotide 17-121 nucleotides in length,
    (2) has an unmodified DNA domain of at least 8 contiguous deoxyribonucleotides,
    (3) is fully complementary in sequence to the sequence of a first strand of the nucleic acid target but for one or more mismatches as between the sequences of said deoxyribonucleotides domain and its complement on the target nucleic acid first strand, each of said mismatches positioned at least 8 nucleotides from said first oligonucleotide's 5' and 3' termini, and
  (4) has at least one terminal modification selected from the group consisting of: at least one terminal locked nucleic acid (LNA), at least one terminal 2'-O-Me base analog, and at least three terminal phophorothioate linkages, and
ii) wherein said second oligonucleotide is selected from the group consisting of
  (1) an oligonucleotide that is fully complementary to the target and lacks the mismatch,
  (2) a fully modified phosphothiolated oligonucleotide,
  (3) a fully modified 2'-O-methylated oligonucleotide, and
  (4) a chimeric double-stranded double hairpin containing RNA and DNA nucleotides, and
iii) wherein said cultured or selectively enriched cells are not human embryonic stem cells, and
iv) wherein said first and second oligonucleotides include the sequence of any one of SEQ ID NOs: 1-4340;

(b) combining the targeted nucleic acid with said first or said second oligonucleotide in the presence of cellular repair proteins;

(c) combining the targeted nucleic acid with the other of said first or said second oligonucleotide in the presence of cellular repair proteins;

(d) quantifying the percentage of target molecules that undergo a sequence alteration event;

(e) comparing the efficiency of alteration of said targeted nucleic acid sequence by said first oligonucleotide with the efficiency of alteration of the same targeted nucleic acid sequence by said second oligonucleotide; and (f) repeating steps (a) through (e) two or more times to optimize said first oligonucleotide for targeted sequence alteration of a nucleic acid.

45. The method of claim 44, wherein said first and second oligonucleotides consist of the sequence of any one of SEQ ID NOs: 1-4340.

\* \* \* \* \*